(12) United States Patent
Zhao et al.

(10) Patent No.: US 12,091,684 B2
(45) Date of Patent: Sep. 17, 2024

(54) PLATELET-DERIVED MITOCHONDRIA TREATMENT AND METHOD OF GENERATING MULTIPOTENT CELLS

(71) Applicant: Hackensack Meridian Health, Inc., Hackensack, NJ (US)

(72) Inventors: Yong Zhao, Nutley, NJ (US); Haibo Yu, Changsha (CN); Wei Hu, Union City, NJ (US); Xiang Song, River Edge, NJ (US)

(73) Assignee: Hackensack Meridian Health, Inc., Edison, NJ (US)

( * ) Notice: Subject to any disclaimer, the term of this patent is extended or adjusted under 35 U.S.C. 154(b) by 139 days.

(21) Appl. No.: 17/176,907

(22) Filed: Feb. 16, 2021

(65) Prior Publication Data

US 2021/0254007 A1    Aug. 19, 2021

Related U.S. Application Data

(60) Provisional application No. 62/976,830, filed on Feb. 14, 2020.

(51) Int. Cl.
| | |
|---|---|
| C12N 5/0789 | (2010.01) |
| A61K 35/17 | (2015.01) |
| A61K 35/30 | (2015.01) |
| C12N 5/0783 | (2010.01) |
| C12N 5/079 | (2010.01) |
| C12N 5/0793 | (2010.01) |

(52) U.S. Cl.
CPC ............ *C12N 5/0647* (2013.01); *A61K 35/17* (2013.01); *A61K 35/30* (2013.01); *C12N 5/0619* (2013.01); *C12N 5/0621* (2013.01); *C12N 5/0636* (2013.01); *C12N 2506/11* (2013.01)

(58) Field of Classification Search
None
See application file for complete search history.

(56) References Cited

U.S. PATENT DOCUMENTS

| | | | |
|---|---|---|---|
| 8,835,163 B2 * | 9/2014 | Zhao | A61K 35/17 435/363 |
| 2015/0110749 A1 | 4/2015 | Vacanti et al. | |
| 2018/0055891 A1 * | 3/2018 | Zhao | C12N 5/0676 |

FOREIGN PATENT DOCUMENTS

| | | |
|---|---|---|
| WO | 2018044795 | 3/2018 |

OTHER PUBLICATIONS

"International Search Report and Written Opinion, PCT/US21/18228".

Agulinick, et al., "Insulin-Producing Endocrine Cells Differentiated In Vitro From Human Embryonic Stem Cells Function in Macroencapsulation Devices In Vivo".
Akashi, et al., "A clonogenic commonmyeloid progenitor that gives rise to allmyeloid lineages".
Andrzejewska, et al., "Concise Review: Mesenchymal Stem Cells: From Roots to Boost".
Anjos, et al., "CD34-Cells at the Apex of the Human Hematopoietic Stem Cell Hierarchy Have Distinctive Cellular and Molecular Signatures".
Ao, Jack, et al., "Retinal pigment epithelium in the pathogenesis of age-related macular degeneration and photobiomodulation as a potential therapy?".
Asmussen, et al., "Regulation of Extracellular Matrix Vesicles via Rapid Responses to Steroid Hormones during Endochondral Bone Formation".
Bapat, et al., "Depletion of fat-resident Treg cells prevents age-associated insulin resistance".
Bemal, et al., "Human b-Cell Proliferation and Intracellular Signaling Part 2: Still Driving in the Dark Without a Road Map".
Blaser, et al., "Making HSCs in vitro: don't forget the hemogenic endothelium".
Bloom, et al., "A Nucleus With Cytoplasmic Features".
Bluestone, et al.
Boyd, et al.
Brandes, et al., "Nuclear Mitochondria".
Butko, et al., "Complex regulation of HSC emergence bythe Notchsignalingpathway".
Calloni, et al., "Reviewing and Updating the Major Molecular Markers for Stem Cells".
Chabannon, et al., "Hematopoietic stem cell transplantation in its 60s: A platform for cellular therapies".
Chichagova, et al., "Cellular regeneration strategies for macular degeneration: past, present and future".
Daubner, et al., "Tyrosine hydroxylase and regulation of dopamine synthesis".
De Obaldia, et al., "Transcriptional Regulation of Innate and Adaptive Lymphocyte Lineages".
Defronzo, et al., "Type 2 diabetes mellitus".
Defuria, et al., "B cells promote inflammation in obesity and type 2 diabetes through regulation of T-cell function and an inflammatory cytokine profile".

(Continued)

*Primary Examiner* — Allison M Fox
*Assistant Examiner* — Alyssa G Weston
(74) *Attorney, Agent, or Firm* — McCarter & English, LLP; Beverly W. Lubit

(57) ABSTRACT

A method of generating multipotent stem cells from adult human peripheral blood cells by isolating the peripheral blood insulin-producing cells and exposing them to adult peripheral blood-derived mitochondria. Adult peripheral blood insulin-producing cells (PB-IPC) are isolated from adult peripheral blood by adherence to a hydrophobic surface with a positive charge, such as a Petri dish. Once the PB-IPC are isolated, mitochondria derived from adult peripheral blood are applied to the isolated PB-IPC. The mitochondria are then taken in by the PB-IPC and enter the nuclei of the PB-IPC, allowing the cells to be reprogrammed, transforming PB-IPC into multipotent stem cells and giving rise to three germ layer-derived cells. Additionally, PB-IPC give rise to functional CD34+ hematopoietic stem cell (HSC)-like cells after treatment with adult peripheral blood-derived mitochondria.

18 Claims, 39 Drawing Sheets

Specification includes a Sequence Listing.

(56) References Cited

OTHER PUBLICATIONS

Delgado, et al., "Modulation of Autoimmune T-Cell Memory by Stem Cell Educator Therapy: Phase 1/2 Clinical Trial".
Doulatov, et al., "Hematopoiesis: A Human Perspective".
Doulatov, et al., "Induction of Multipotential Hematopoietic Progenitors from Human Pluripotent Stem Cells via Respecification of Lineage-Restricted Precursors".
Finneman, et al.
Gambell, et al., "Peripheral Blood CD341 Cell Enumeration as a Predictor of Apheresis Yield: An Analysis of More Than 1,000 Collections".
Gori, et al., "Vascular niche promotes hematopoietic multipotent progenitor formation from pluripotent stem cells".
Hao, et al., "Identification of a novel, human multilymphoid progenitor in cord blood".
Jensen, et al., "Ultrastructure of Mitochondria-Containing Nuclei in Human Myocardial Cells".
Kanakry, et al., "Modern approaches to HLA-haploidentical blood or marrow transplantation".
Kelly, et al., "C ell-surface markers for the isolation of pancreatic cell types derived from human embryonic stem cells".
Krebsbach, et al., "The Role of Integrin a6 (CD49f) in Stem Cells: More than a Conserved Biomarker".
Kroon, et al., "Pancreatic endoderm derived from human embryonic stem cells generates glucose-responsive Insulin-secreting cells in vivo".
Kushner, et al., "Stem Cells to Insulin Secreting Cells: Two Steps Forward and Now a Time to Pause?".
Li, et al., "Hair regrowth in alopecia areata patients following Stem Cell Educator therapy".
Liu, et al., "Genetic deficiency and pharmacological stabilization of mast cells reduce diet-induced obesity and diabetes in mice".
Lofty, et al., "Chronic Complications of Diabetes Mellitus: A Mini Review".
Matsuoka, et al., "The MafA transcription factor appears to be responsible for tissue-specific expression of insulin".
Nanditha, et al., "Effect of Long-Acting Insulin Analogs on the Risk of Cancer: A Systematic Review of Observational Studies".
Nishimura, et al., "Mechanisms of the Metabolic Shift during Somatic Cell Reprogramming".
Notta, et al., "Distinct Routes of Lineage Development Reshape the Human Blood Hierarchy Across Ontogeny".
Odorico, et al., "Report of the Key Opinion Leaders Meeting on Stem Cell-derived Beta Cells".
Okita, et al., "An Efficient Nonviral Method to Generate Integration-Free Human-Induced Pluripotent Stem Cells from Cord Blood and Peripheral Blood Cells".
Olefsky, et al., "Macrophages, Inflammation, and Insulin Resistance".
Rezania, et al., "Reversal of diabetes with insulin-producing cells derived in vitro from human pluripotent stem cells".
Schultz, et al., "Human Lymphoid and Myeloid Cell Development in NOD/LtSz-scid IL2Rgnull Mice Engrafted with Mobilized Human Hemopoietic Stem Cells".
Sneddon, et al., "Stem Cell Therapies for Treating Diabetes: Progress and Remaining Challenges".
Staal, et al., "Stem cell self-renewal: lessons from bone marrow, gut and iPS toward clinical applications".
Stewart, et al., "Human b-Cell Proliferation and Intracellular Signaling: Part 3".
Sugimura, et al., "Haematopoietic stem and progenitor cells from human pluripotent stem cells".
Swart, et al., "Haematopoietic stem cell transplantation for autoimmune diseases".
Takemura, et al., "Intranuclear Mitochondria in Human Myocardial Cells".
Talukdar, et al., "Neutrophils mediate insulin resistance in mice fed a high-fat diet through secreted elastase".
Tsai, et al., "Are Obesity-Related Insulin Resistance and Type 2 Diabetes Autoimmune Diseases?".
Veres, et al., "Charting cellular identity during human in vitro B-cell differentiation".
Wahlster, et al., "Progress towards generation of human haematopoietic stem cells".
Weber, et al., "Hey bHLH Transcription Factors".
Winer, D, et al., "B cells promote insulin resistance through modulation of T cells and production of pathogenic IgG antibodies".
Winer, Shawn, et al., "Normalization of obesity-associated insulin resistance through immunotherapy".
Winer, Shawn, et al., "The adaptive immune system as a fundamental regulator of adipose tissue inflammation and insulin resistance".
Wong, et al., "Diabetes and risk of physical disability in adults: a systematic review and meta-analysis".
Woods, et al., "Brief Report: Efficient Generation of Hematopoietic Precursors and Progenitors from Human Pluripotent Stem Cell Lines".
Wu, et al., "Eosinophils Sustain Adipose Alternatively Activated Macrophages Associated with Glucose Homeostasis".
Ku, et al., "Prevalence and Control of Diabetes in Chinese Adults".
Yamamoto, et al., "Clonal Analysis Unveils Self-Renewing Lineage-Restricted Progenitors Generated Directly from Hematopoietic Stem Cells".
Yu, et al., "Generation of Multipotent Stem Cells from Adult Human Peripheral Blood Following the Treatment with Platete-Derived Mitochondria", Cells, vol. 9, No. 1350, May 29, 2020, 1-18.
Zhao, et al., "A human peripheral blood monocyte-derived subset acts as pluripotent stem cells".
Zhao, et al., "A unique human blood-derived cell population displays high potential for producing insulin".
Zhao, et al., "Human cord blood stem cells and the journey to a cure for type 1 diabetes".
Zhao, et al., "Humanized Mice Reveal Differential Immunogenicity of Cells Derived from Autologous Induced Pluripotent Stem Cells".
Zhao, et al., "Identification of stem cells from human umbilical cord blood with embryonic and hematopoietic characteristics".
Zhao, et al., "Immunogenicity of induced pluripotent stem cells".
Zhao, et al., "Platelet-Derived Mitochondria Display Embryonic Stem Cell Markers and Improve Pancreatic Islet beta-cell Function in Humans", Stem Cells Translational Medicine, vol. 6, 2017, 1684-1697.
Zhao, et al., "Reversal of type 1 diabetes via islet b cell regeneration following immune modulation by cord blood-derived multipotent stem cells".
Zhao, et al., "Targeting insulin resistance in type 2 diabetes via immune modulation of cord blood-derived multipotent stem cells (CB-SCs) in stem cell educator therapy: phase I/II clinical trial".

* cited by examiner

PLATELET-DERIVED MITOCHONDRIA TREATMENT AND METHOD OF GENERATING MULTIPOTENT CELLS

CROSS-REFERENCE TO RELATED APPLICATION

This application claims priority in U.S. Provisional Patent Application No. 62/976,830, filed Feb. 14, 2020, which is incorporated herein by reference in its entirety.

REFERENCE TO A SEQUENCE LISTING SUBMITTED VIA EFS-WEB

The content of the ASCII text file of the sequence listing named "5700NP_and_PCT_Sequence_Listing_ST25," which is 1,595 KB in size and was created on Feb. 15, 2021 and electrically submitted via EFS-Web herewith the application, is incorporated herein by reference in its entirety.

BACKGROUND OF THE INVENTION

1. Field of the Invention

The present invention relates generally to medical treatments and, more specifically, to treating adult human peripheral blood cells with platelet-derived mitochondria to generate multipotent cells for treatment of chronic medical conditions.

2. Description of the Related Art

Many chronic medical conditions, including but not limited to cancers, Alzheimer's disease, and diabetes, affect the health of millions of people daily, yet treatments available for many of these conditions remain largely ineffective. Diabetes is a major public health concern which affects over 350 million people worldwide. Prevalence of diabetes exceeds 12.1% of the population in India, 11.6% in China, and 9.3% in the United States, and approximately one billion people worldwide are considered pre-diabetic, with higher than normal blood sugar levels. Diabetes is the sixth leading cause of death in the U.S. and is associated with increased risk for heart disease, stroke, kidney disease, blindness, and amputations.

A common factor in both type 1 diabetes (T1D) and type 2 diabetes (T2D) is immune system dysfunction. T1D is characterized by autoimmune destruction of pancreatic islet β cells and disruption of immune cells including T cells, B cells, regulatory T cells (Tregs), monocytes/macrophages (Mo/Mφs), dendritic cells (DCs), natural killer (NK) cells, and natural killer T (NKT) cells. While T2D is largely characterized by insulin resistance and aberrant production of insulin, chronic low-grade inflammation also occurs in peripheral tissues such as adipose tissue, the liver, and muscle tissue, further contributing to the disease. Specifically, studies have shown T cells to be unexpected promoters and controllers of insulin resistance. T cells promote recruitment of inflammatory macrophages to adipose depots and produce inflammatory cytokines, which promote the development of insulin resistance that can lead to diabetes. Despite more than 30 years of intense research, cures for both T1D and T2D remain elusive. Comprehensive immune modulation via both local and systematic approaches are needed to simultaneously address the multiple immune dysfunctions that underlie these diseases.

A deficit of insulin-producing cells is another crucial and common issue for diabetes patients. While supplemental insulin provides T1D patients a means to manage blood sugar, it is not a cure, and insulin does not address the underlying immune dysfunction that causes pancreatic islet β-cell destruction. To overcome the shortage of insulin-producing cells in diabetic patients, pancreas and islet transplantations have offered potential treatments for independence from insulin injections. However, donor scarcity and the risk of immune rejection severely hinders the potential for wide application of such transplantations. Thus, there remains a compelling need and sense of urgency to find a cure for diabetes that not only halts the progression of autoimmunity in T1D and corrects multiple immune dysfunctions in T2D, but also overcomes the shortage of insulin-producing β-cells.

Stem cell research has the potential to revolutionize treatments for certain life-changing injuries and human diseases, such as but not limited to diabetes, Alzheimer's disease, cancers, and alopecia areata. To date, researchers have characterized multiple types of human stem cells with varying potentials for regeneration, and animal studies and human trials have demonstrated the translational capability of stem cells to treat human diseases.

To date, functional insulin-producing cells or islet cells have been generated from embryonic stem (ES) cells and induced pluripotent stem cells (iPS) through ex vivo induction of differentiations. However, recent advances in stem cell biology have realized that ES cells, iPS, and their derived cells can also cause immune rejections post transplantation, challenging their clinical therapeutic potentials. Accordingly, encapsulation with different biomaterials and the use of a semipermeable membranes and capsules have been evaluated through animal and pilot clinical studies in an effort to avoid attack by immune cells on transplanted cells and/or cell-delivery devices and to provide sufficiently-permeabilized nutrients to sustain cell viability. However, formation of fibrosis, or scarring around the device, which causes death of capsulized cells and failure of encapsulation devices, is still a major roadblock, and the optimal membrane or capsule device has yet to be developed.

For over three decades now, the most common stem cell therapy approved by the U.S. Food and Drug Administration (FDA) has been hematopoietic cell transplantation (HCT) (also known as hematopoietic stem cell transplantation or HSCT). HCT has been approved for treatment of bone marrow failure, malignant blood disorders, genetic-based blood disorders, and autoimmune diseases as well as for post-chemotherapy and/or post-radiation cell regeneration. However, several major limitations have restricted the broad clinical application of allogeneic HCT. These limitations include the difficulty in identifying a human leukocyte antigen (HLA) fully-matched or haploidentical donor; the scarcity of hematopoietic stem cells (HSC), which are known to be identified by glycosylated transmembrane protein marker CD34, amongst all sources of harvested cells (≤1%); and most particularly, by the incidence of graft-versus-host disease (GVHD), opportunistic infections, relapse of primary disease, and toxicities associated with immunosuppressive drugs and radiation. An autologous source of HSC would address the problems of matching and GVHD, but engraftment could still be hampered by the limited number of CD34$^+$ HSC.

Since the success rate of engraftment for clinical HCT is correlated with the number of functional CD34$^+$ hematopoietic progenitor cells (HPC) and HSC in the transplant, researchers have evaluated whether embryonic stem (ES)

cells and/or induced pluripotent stem (iPS) cells can be manipulated to produce HSC through reprogramming by small molecules or by viral transduction of transcription factors. Thus far, these approaches have been limited by an inability to generate true functional HSC in sufficient numbers for therapeutic use, as well as safety and ethical concerns and potential immune rejection issues to ES or iPS derivatives.

The use of autologous stem cells for regenerative medicine is more ethically acceptable and likely more successful than the use of other stem cells, and such therapies would avoid many of the immune rejection and safety concerns associated with other stem cells (e.g., ES- or iPS-based therapies). What is needed is a method of generating autologous multipotent cells for use in regenerative medicine.

Heretofore there has not been available a method for generating multipotent cells for medical treatment with the advantages and features of the present invention.

SUMMARY OF THE INVENTION

The present invention discloses a method of generating multipotent stem cells from adult human peripheral blood cells by isolating the peripheral blood insulin-producing cells and exposing them to platelet-derived mitochondria. In an aspect of the present invention, adult peripheral blood insulin-producing cells (PB-IPC) are isolated from adult peripheral blood via attachment to a hydrophobic surface with a positive charge. Once the PB-IPC are isolated, mitochondria derived from platelets are applied to the isolated PB-IPC. The mitochondria are then taken in by the PB-IPC and enter the nuclei of the PB-IPC, allowing the cells to be reprogrammed, transforming PB-IPC into multipotent stem cells and giving rise to three germ layer-derived cells.

PB-IPC can be easily isolated from peripheral blood and expanded in serum-free culture medium to avoid the painful and invasive procedures required to withdraw bone marrow. Using autologous PB-IPC from patients as a starting material, mitochondrial treatment can generate functional autologous mitochondrion-induced peripheral blood insulin-producing cells (miPB-IPC) on a large scale, giving rise to different cell lineages. Differentiation of these miPB-IPC into multiple lineages at high efficiency, such as T cells, B cells, monocytes/macrophages (MΦ), granulocytes (Gr), erythrocytes (Er), megakaryocytes (MKs)/platelets, retinal pigment epithelium (RPE), and neuronal cells, demonstrates the multipotency of PB-IPC post-mitochondrial reprogramming. Thus, these cells offer great promise as a solution for the current bottlenecks associated with conventional stem cell transplants and have tremendous potential for patient benefit in the clinic.

PB-IPC naturally circulates in human peripheral blood, displaying islet β cell-related markers and reducing hyperglycemia with migration to pancreatic islets. The present invention provides a novel approach for the generation of a large amount of autologous insulin-producing cells from patients themselves to potentially treat diabetes in clinics after optimizing ex vivo culture conditions. In contrast with the generation of insulin-producing cells from ES and iPS cells, the present technology can efficiently isolate insulin-producing cells from their own blood, without any ethical issues and without the hazards of immune rejection. Moreover, multipotent differentiation of miPB-IPC into other cell lineages accommodates treatment for not only diabetic subjects but for the whole field of regenerative medicine.

In another aspect of the present invention, PB-IPC give rise to functional CD34+ hematopoietic stem cell (HSC)-like cells after treatment with platelet-derived mitochondria, designated herein as mitochondrion-induced CD34+ HSC (miCD34+ HSC). The miCD34+ HSC of the present invention can reconstitute multi-lineage blood cells in peripheral blood, the spleen, and bone marrow after transplant into irradiated NSG mice at 12 weeks, including but not limited to T cells (CD3+CD4+), B cells (CD19+), monocytes/macrophages (CD14+), granulocytes (CD66b+), erythroid cells (CD235a+), and megakaryocytes/platelets (CD41b+), highlighting the high potential to treat hematopoietic-associated diseases.

The capacity of self-renewal is one of the major characteristics for CD34+ HSC. The miCD34+ HSC exhibit a rapid multiple potential for differentiation, with a limited potential of self-renewal, meaning the mitochondrial reprogramming, differentiating the PB-IPC into CD34+ HSC-like cells with expressions of HSC-associated cell surface markers and primarily improving their multi-potency of differentiation potential, does not significantly change their capability of self-renewal.

BRIEF DESCRIPTION OF THE DRAWINGS

The drawings constitute a part of this specification and include exemplary embodiments of the present invention illustrating various objects and features thereof.

DETAILED DESCRIPTION OF THE PREFERRED EMBODIMENTS

I. Introduction and Environment

As required, detailed aspects of the present invention are disclosed herein, however, it is to be understood that the disclosed aspects are merely exemplary of the invention, which may be embodied in various forms. Therefore, specific structural and functional details disclosed herein are not to be interpreted as limiting, but merely as a basis for the claims and as a representative basis for teaching one skilled in the art how to variously employ the present invention in virtually any appropriately detailed structure.

Certain terminology will be used in the following description for convenience in reference only and will not be limiting. For example, up, down, front, back, right and left refer to the invention as orientated in the view being referred to. The words, "inwardly" and "outwardly" refer to directions toward and away from, respectively, the geometric center of the aspect being described and designated parts thereof. Forwardly and rearwardly are generally in reference to the direction of travel, if appropriate. Said terminology will include the words specifically mentioned, derivatives thereof and words of similar meaning.

II. Preferred Embodiment

Figure 1:
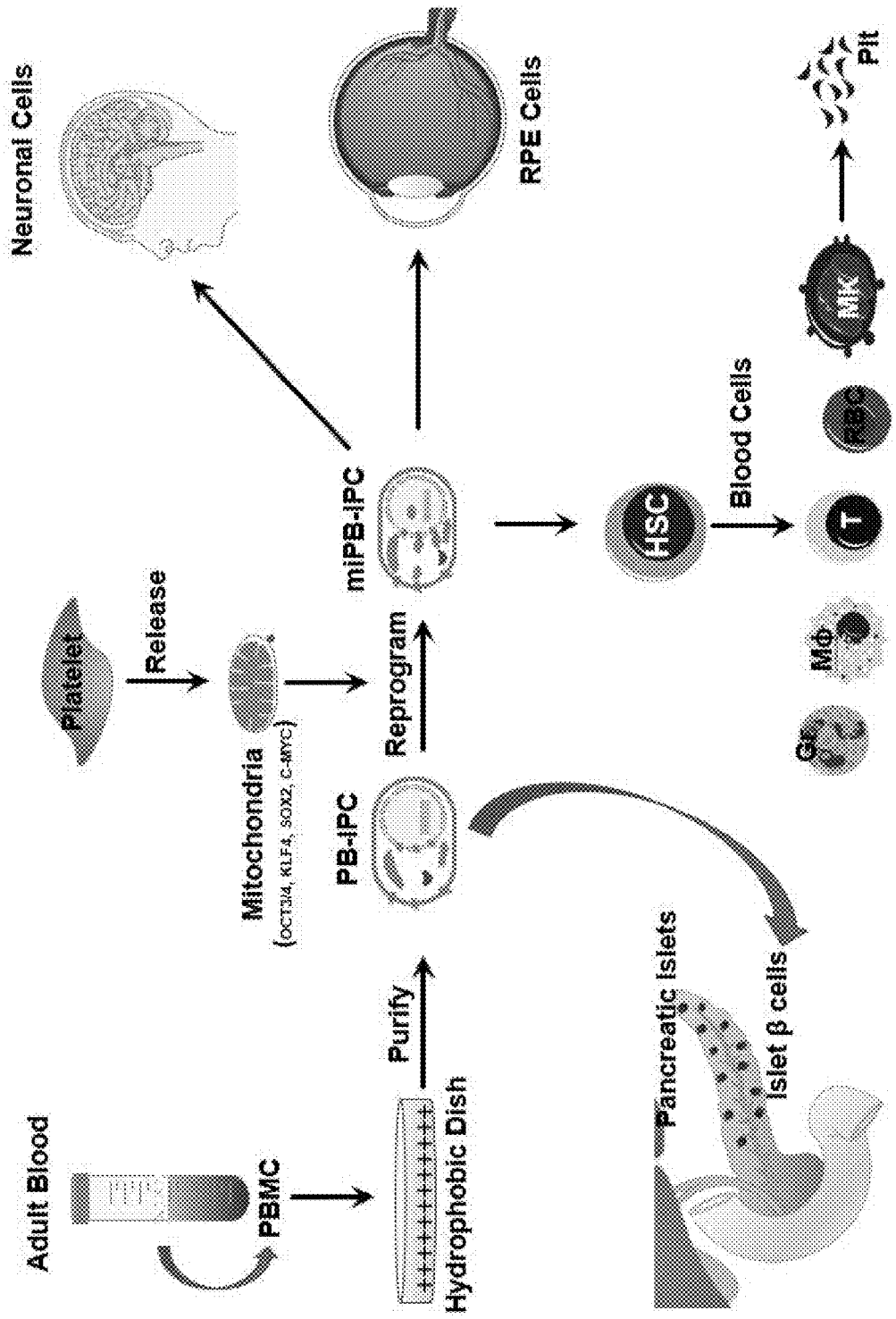
FIG. 1 is a schematic drawing illustrating a method of generating multipotent cellular differentiation by treating peripheral blood insulin-producing cells with platelet-derived mitochondria, the method embodying the present invention.

The present invention discloses a method of generating multipotent stem cells from adult human peripheral blood cells by isolating the peripheral blood insulin-producing cells (PB-IPC) and exposing them to platelet-derived mitochondria. PB-IPC, also known as "peripheral blood-stem cell (PB-SC)," have further been characterized by Zhao et al. in U.S. Pat. No. 8,835,163, which is incorporated herein by reference in its entirety. FIG. 1 shows a schematic drawing of an embodiment of a protocol of the present invention.

PB-IPC have been demonstrated to be present within human peripheral blood, displaying a unique phenotype (Lin1$^-$CD34$^-$CD45$^+$CD45RO$^+$CCR7$^+$SOX2$^+$OCT3/4$^+$ MAFA$^+$Glut2$^+$). In an exemplary embodiment, a sample of adult human peripheral blood is first obtained and centrifuged. After centrifugation, peripheral blood-derived mononuclear cells (PBMC) are then isolated from the adult peripheral blood. PB-IPC are then isolated from the PBMC via adherence to a hydrophobic surface having a positive charge. In a preferred embodiment, PB-IPC are isolated, grown, and expanded by adhering to the hydrophobic bottom of Petri dishes in chemical-defined, serum-free culture without adding any other growth factors. However, in alternative embodiments, other devices and/or media having a hydrophobic surface may be utilized to isolate PB-IPC.

In an exemplary embodiment, a sample of adult human peripheral blood platelets is obtained. In embodiments of the present invention, the platelet sample may be taken from the same peripheral blood sample as the isolated PB-IPC or alternatively from another adult human peripheral blood source. Mitochondria are then isolated from peripheral blood platelets. The platelet-derived mitochondria may be isolated as described herein or by alternative mitochondria isolation methods.

Once the PB-IPC and platelet-derived mitochondria are isolated, the platelet-derived mitochondria are applied to the isolated PB-IPC. Upon such treatment, the mitochondria are then taken in by the PB-IPC, allowing the cells to be reprogrammed and transforming PB-IPC into multipotent stem cells giving rise to three germ layer-derived cells. Upon entry into the PB-IPC, some of the applied, platelet-derived mitochondria enter the nuclei of the PB-IPC, accommodating reprogramming of the cells.

The differentiation potential of PB-IPC is markedly increased after treatment with platelet-derived mitochondria, leading to three-germ layer-derived cells. Mitochondrion-induced PB-IPC (miPB-IPC) exhibit high efficiency of differentiations toward RPE and neuronal cells in the presence of different inducers, respectively, confirming the multipotency of PB-IPC post-mitochondrial treatment. Thus, these cells offer great promise as a solution for the current bottlenecks associated with conventional stem cell transplants and have tremendous potential for patient benefit in the clinic.

PB-IPC naturally circulate in human peripheral blood, displaying islet β cell-related markers and reducing hyperglycemia with migration to pancreatic islets after transplant into the chemical streptozotocin (STZ)-induced diabetic mice. Accordingly, the present invention provides a novel approach for the generation of a large amount of autologous insulin-producing cells from patients themselves to potentially treat autoimmune disease in clinics. In comparison with the generation of insulin-producing cells from ES and iPS cells, the present technology can efficiently isolate insulin-producing cells from their own blood, without any ethical issues nor the hazards of immune rejection. Moreover, multipotent differentiation of miPB-IPC into other cell lineages provides previously unmet medical needs to circumvent those limitations not only for autoimmune disease subjects, but for the entire field of regenerative medicine. In embodiments of the present invention, miPB-IPC can differentiate into macrophage cells, neuronal cells, RPE cells, granulocyte cells, T cells, B cells, red blood cells, megakaryocyte cells, platelet cells, bone marrow cells, stromal cells, osteoblast cells, keratinocytes, hair follicle cells, gland cells, endothelial cells, corneal endothelial cells, cardiomyocytes, muscle cells, epithelial cells, hepatocytes, kidney cells, islet β cells, or other types of cells when exposed to the appropriate promoters for each.

In alternative embodiments, PBMC-derived (not platelet-derived) mitochondria are isolated and applied to PB-IPC. Upon treatment, PBMC-derived mitochondria enter the PB-IPC and also penetrate the nucleus of PB-IPC, accommodating reprogramming of the cell. In further embodiments of the present invention, mitochondria can be isolated from blood plasma, blood serum, or other parts of human blood and utilized in treating PB-IPC.

In another aspect of the present invention, PB-IPC give rise to functional CD34+ hematopoietic stem cell (HSC)-like cells after treatment with platelet-derived mitochondria, designated herein as mitochondrion-induced CD34+ HSC (miCD34+ HSC). Using autologous PB-IPC from patients as a starting material, mitochondrial treatment generates functional autologous mitochondrion-induced CD34$^+$ (miCD34$^+$) hematopoietic stem cells (HSC) on a large scale, giving rise to different blood cell lineages. Isolating PB-IPC from peripheral blood and expanding them is accomplished utilizing serum-free, culture medium having a hydrophobic surface, which avoids the painful and invasive procedures required to withdraw bone marrow. Isolated, platelet-derived mitochondria are then applied to the PB-IPC, which mitochondria enter the PB-IPC and then the nuclei of PB-IPC, allowing for reprogramming of the cells. The mitochondrion-induced PB-IPC are then further exposed to blood cell promoters for HSC-like differentiation.

Figure 2:
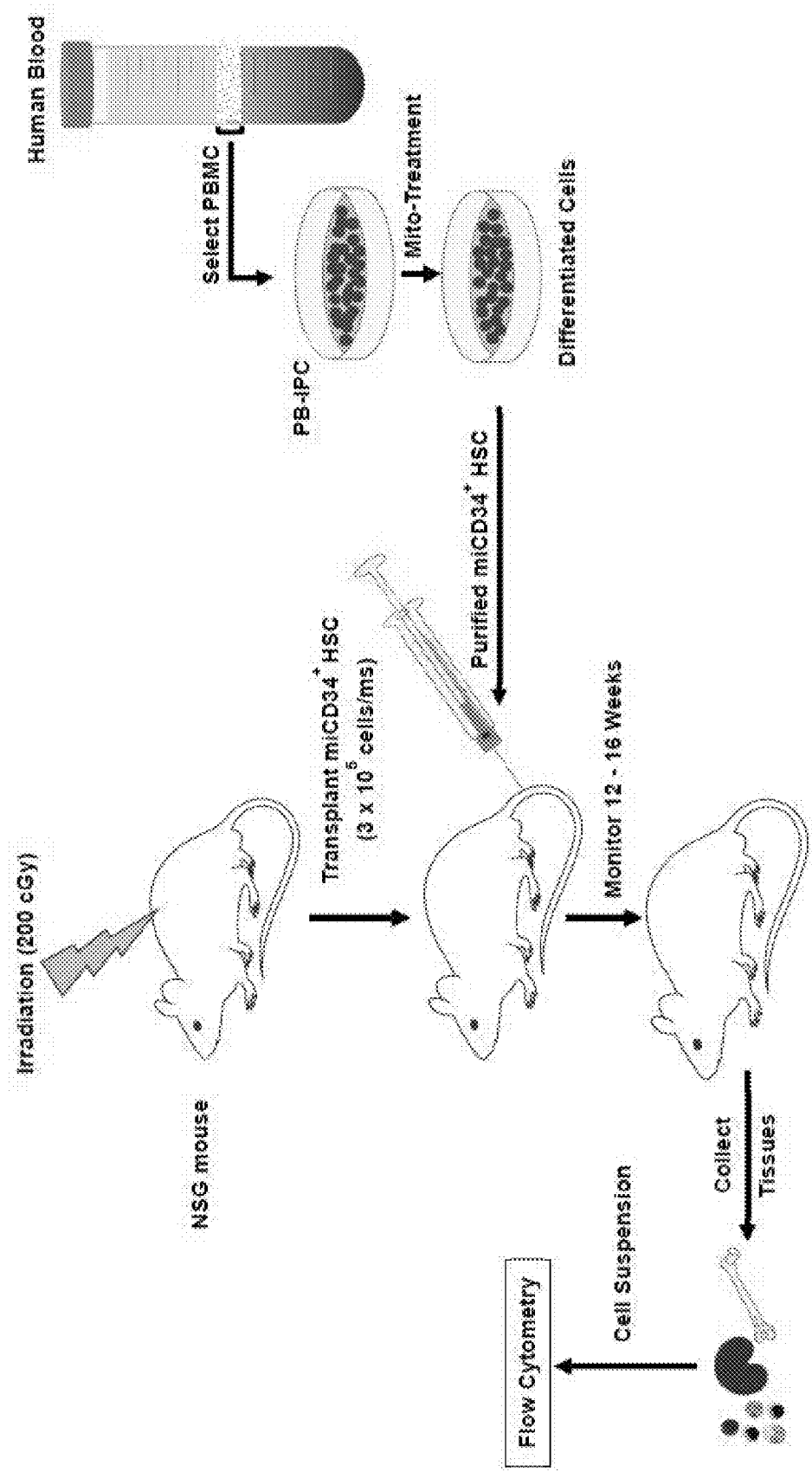
FIG. 2 is a schematic drawing illustrating a method and animal protocol embodying an aspect of the present invention for in vivo multiple differentiation of mitochondrion-induced CD34+ hematopoietic stem cell-like cells after transplantation into irradiated NSG mice.
Figure 3:
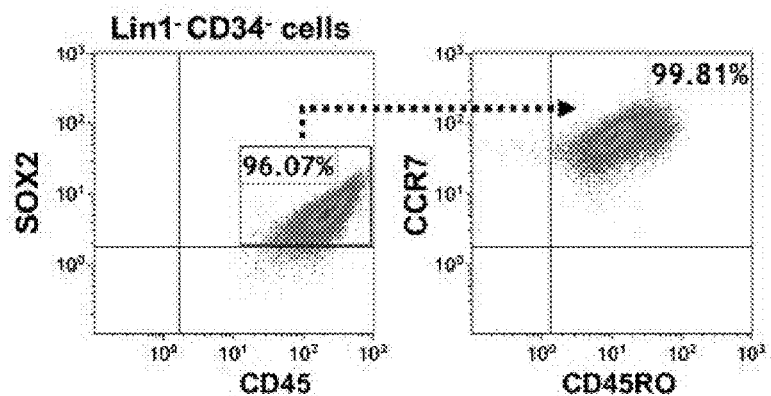
FIG. 3 shows flow cytometry graphs showing characterization of peripheral blood-derived insulin-producing cells (PB-IPC) from adult peripheral blood with islet β-cell related markers demonstrating that gated Lin1$^-$CD34$^-$ cells express CD45, SOX2, CD45RO, and CCR7 (n=8).

An animal protocol embodying the present invention is shown in FIG. 2. The miCD34+ HSC of the present invention can reconstitute multi-lineage blood cells in peripheral blood, the spleen, and bone marrow after transplantation into irradiated NSG mice at 12 weeks, including but not limited to T cells (CD3+CD4+), B cells (CD19+), monocytes/macrophages (CD14+), granulocytes (CD66b+), erythroid cells (CD235a+), and megakaryocytes/platelets (CD41b+). This demonstrates the high potential to treat hematopoietic-associated diseases with the present invention.

The capacity of self-renewal is one of the major characteristics for CD34+ HSC. The miCD34+ HSC of the present invention have exhibited a rapid multiple potential for differentiation, with a limited potential of self-renewal, meaning the mitochondrial reprogramming, differentiating the PB-IPC into CD34+ HSC-like cells with expressions of HSC-associated cell surface markers and primarily improving their multi-potency of differentiation potential, does not significantly change their capability of self-renewal.

III. Materials and Methods for Generation of Multipotent Stem Cells from miPB-IPC

A. PB-IPC Cell Culture

Human buffy coat blood units (n=42; mean age of 47.64±14.07; age range from 16 to 73 years old; 23 males and 19 females) were purchased from the New York Blood Center (New York, NY, USA). Human buffy coats were initially added to 40 mL of chemical-defined serum-free culture X-VIVO™ 15 medium (Lonza, Walkersville, MD, USA), mixed thoroughly with a 10 mL pipette, and then used for isolation of peripheral blood-derived mononuclear cells (PBMC). PBMC were harvested as previously described by Zhao et al. in "A human peripheral blood monocyte-derived subset acts as pluripotent stem cells." *Proc. Natl. Acad. Sci. U.S.A.* 2003, 100, 2426-2431, which is incorporated herein by reference in its entirety. The mononuclear cells were isolated from buffy coats blood using Ficoll-Paque™ PLUS ($\gamma$=1.007, GE Healthcare), followed by removing the red blood cells using Red Blood Cell Lysis buffer (eBioscience, San Diego, CA, USA). After three washes with saline, the whole PBMC were seeded in 150×15 mm Petri dishes (BD, Franklin Lakes, NJ, USA) at $1\times10^6$ cells/mL, 25 mL/dish in chemical-defined serum-free culture X-VIVO IM 15 medium (Lonza, Walkersville, MD, USA), without adding any other growth factors, and incubated at 37° C. in 8% $CO_2$. Seven days later, peripheral blood insulin-producing cells (PB-IPC) were growing and had expanded by adhering to the hydrophobic bottom of the Petri dishes. Consequently, PB-IPC were washed three times with saline, and all floating cells were removed. Serum-free NutriStem® hPSC XF culture medium (Corning, New York, NY, USA) was then added for continued cell culture and expansion at 37° C. in 8% $CO_2$. The expanded PB-IPC were usually applied for experiments during 7-14 days. PB-IPC were treated with 100 μg/mL platelet-derived mitochondria for 7-14 days in non-treated 24-well plates or Petri dishes with serum-free NutriStem® hPSC XF culture medium (Corning), at 37° C. and 8% $CO_2$.

B. Isolation of Mitochondria from Platelets

Mitochondria were isolated from peripheral blood (PB)-platelets using a Mitochondria Isolation kit (Thermo Scientific, Rockford, IL, USA, Prod: 89874) according to the manufacturer's recommended protocol. Adult human platelet units (n=19) were purchased from the New York Blood Center (New York, NY, USA). The concentration of mitochondria was determined by measuring protein concentration using a NanoDrop 2000 Spectrophotometer (ThermoFisher Scientific, Waltham, MA, USA). The isolated mitochondria were aliquoted and kept in a −80° C. freezer in preparation for experiments.

For mitochondrial staining with fluorescent dyes, mitochondria were labeled with MitoTracker Deep Red FM (100 nM) (Thermo Fisher Scientific, Waltham, MA, USA) at 37° C. for 15 minutes, according to the manufacturer's recommended protocol, followed by two washes with phosphate-buffered saline (PBS) at 3000 rpm×15 minutes.

C. Flow Cytometry

Flow cytometric analyses of surface and intra-cellular markers were performed. PB-IPC were washed with PBS at 2000 rpm for 5 minutes. Mitochondria were washed with PBS at 12,000 g for 10 minutes at 4° C. PB-IPC's nuclei were washed with PBS at 500 g for 5 minutes at 4° C. Samples were pre-incubated with human BD Fc Block (BD Pharmingen, San Jose, CA, USA) for 15 minutes at room temperature, and then directly aliquoted for different antibody staining. Cells were incubated with different mouse anti-human monoclonal antibodies (mAb) from Beckman Coulter (Brea, CA, USA), including FITC-conjugated anti-CD45RO, anti-CD19, anti-CD4, anti-CD8 and anti-CD42a; phycoerythrin (PE)-conjugated anti-CD34, anti-CCR7 and anti-CXCR4; phycoerythrin-Cy5.5 (PE-Cy5.5)-conjugated anti-CD19, anti-CD117 and anti-SOX2; phycoerythrin-Cy7 (PE-Cy7)-conjugated anti-CD41, anti-CD11b and anti-CD45; APC-conjugated anti-CD34, anti-CXCR4, and anti-CD4; APC-Alexa Fluor 750-conjugated, anti-CD66b and anti-CD8; pacific blue (PB)-conjugated anti-CD38; Krome Orange-conjugated anti-CD14. From BD Biosciences (San Jose, CA, USA), the investigator purchased the FITC-conjugated anti-human lineage cocktail 1 (Lin1) (CD3, CD14, CD16, CD19, CD20, CD56), Alexa Fluor 488-Sox2, Alexa Fluor 647-conjugated mouse anti-human C-peptide and insulin Abs. FITC-conjugated anti-human MAFA ab was obtained from United States Biological (Salem, MA, USA). APC-conjugated mouse anti-human CD36 mAb was purchased from BioLegend (San Diego, CA, USA). PE-conjugated anti-human GLUT2 antibody was purchased from R & D Systems (Minneapolis, MN, USA). Mouse anti SDF-1 polyclonal antibody was purchased from Abcam (Cambridge, MA, USA). The eFluor 660-conjugated rat anti-human OCT3/4 and isotype-matched IgG Abs were from Thermo Fisher Scientific (Waltham, MA, USA).

For surface staining, cells were stained for 30 minutes at room temperature and then washed with PBS at 2000 rpm for 5 minutes prior to flow analysis. Isotype-matched mouse anti-human IgG antibodies (Beckman Coulter) served as a negative control for all fluorescein-conjugated IgG mAb. For intra-cellular staining, cells were fixed and permeabilized according to the PerFix-nc kit (Beckman Coulter) manufacturer's recommended protocol. After staining, cells were collected and analyzed using a Gallios Flow Cytometer (Beckman Coulter) equipped with three lasers (488 nm blue, 638 red, and 405 violet lasers) for the concurrent reading of up to 10 colors. The final data were analyzed using the Kaluza Flow Cytometry Analysis Software (Kaluza Analysis 2.1, Beckman Coulter).

To determine insulin-producing cells in mouse peripheral blood, MIP-GFP transgenic mice were tested according to the approved animal protocol by the Institutional Animal Care and Use Committee (IACUC). MIP-GFP transgenic mice were purchased from the Jackson Laboratory (Bar Harbor, ME, USA). The strain name is B6.Cg-Tg(Ins1-EGFP)1 Hara/J (Stock Number: 006864).

D. Retinal Pigment Epithelium (RPE) Cell Differentiation of miPB-IPC

To determine mitochondrion-induced PB-IPC (miPB-IPC)'s multipotency and retinal pigment epithelium (RPE) cell differentiation (FIGS. 1 and 43), miPB-IPC were treated with combined supplements (including L-glutamine, Gentamicin sulfate-Amphotericin (GA-1000), and basic fibroblast growth factor) in the presence of retinal pigment epithelial growth media (Lonza) for 8 days, in 24-well tissue culture-treated plates, at 37° C. in 5% $CO_2$. The differentiated cells were characterized by immunocytochemistry with RPE-specific markers such as mouse anti-human mAbs RPE 65, CRALBP, and claudin-19, along with rabbit anti-tight junction protein 1 (ZO-1) polyclonal Ab (Novus Biological, Littleton, CO, USA). Human primary RPE cells were purchased from Lonza and served as a positive control. Isotype-matched IgG served as a negative control for immunostaining. For functional analysis, the phagocytosis of fluorescence latex beads (Sigma, Saint Louis, MO, USA) were performed in differentiated RPE cells. The phagocytosis-associated surface marker CD36 was examined by flow cytometry. The level of CD36 expression was quantified by mean fluorescence intensity after analyzed with Kaluza software version 2.1 (Beckman Coulter).

E. Neuronal Differentiation of miPB-IPC

To determine miPB-IPC's multipotency and their neuronal cell differentiation (FIGS. 1 and 43), miPB-IPC were treated with 100 ng/ml of neuronal growth factor (NGF, R & D Systems) plus human neuronal stem cell growth medium (iXCells Biotechnologies, San Diego, CA, USA) for 3 to 5 days, in 24-well tissue culture-treated plates, at 37° C. in 5% $CO_2$. Differentiated cells were characterized by immunocytochemistry with mouse anti-human tyrosine hydroxylase monoclonal Ab (mAb, Clone LNC1, Catalogue #MAB 318, at 1:100 dilution) and rabbit anti-Synapsin I polyclonal Ab (Catalogue #AB1543, at 1:100 dilution) (EMD Millipore, Temecula, CA, USA). The FITC-conjugated AffiniPure donkey anti-mouse 2nd Ab and Cy3-conjugated AffiniPure donkey anti-rabbit 2nd Ab were purchased from Jackson ImmunoResearch Laboratories (West Grove, PA, USA). Isotype-matched IgG served as negative control for immunostaining. After covering with Mounting Medium with DAPI (Vector Laboratories, Burlingame, CA, USA), cells were photographed with a Nikon AIR confocal microscope on a Nikon Eclipse Ti2 inverted base.

F. Colony Analysis

Figure 43:
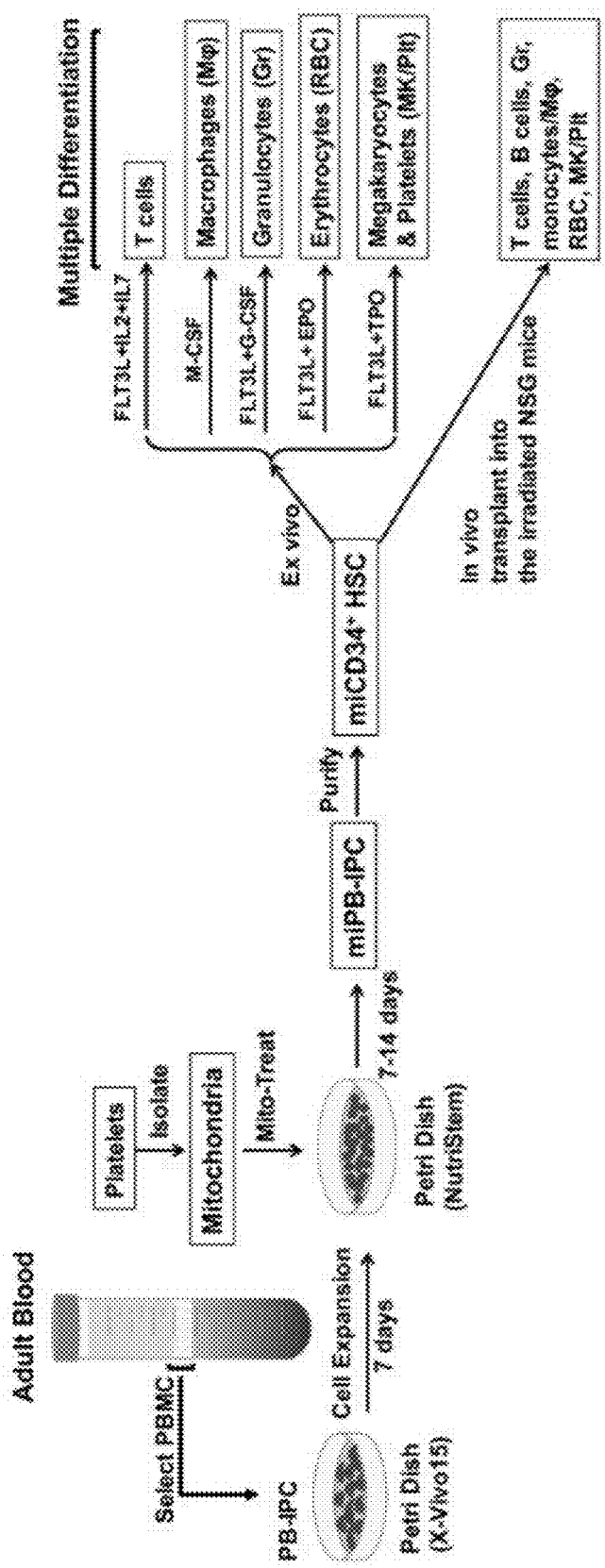
FIG. 43 is a schematic flow chart outlining a protocol of the present invention from the generation of miPB-IPCs to multipotent cellular differentiations of miPB-IPCs. The miCD34$^+$ HSCs were purified for in vitro and in vivo differentiations, respectively.

The miPB-IPC were initially cultured with serum-free NutriStem® hPSC XF culture medium (Corning) at $1×10^4$ cells/mL/well in 24-well tissue culture plates, at 37° C. in 8% $CO_2$ culture condition. After the miPB-IPC were cultured for 2 months, an individual colony was picked up under an inverted microscope by a BD Vacutainer Blood Collection Set (21G×¾"×12") attached with a 3 ml syringe (Nipro, Miami, FL, USA) and inoculated in 96-well plates. Inspection by light microscope indicated that approximately 80% of wells included a single colony. The wells with more than one colony were excluded. Each single colony (total n=21 colonies) was manually dispersed by pipetting and aliquoted to 2-8 wells (depending on the size of colonies) for induction of differentiation (FIGS. 1 and 43). The differentiation of single-colony-derived cells into different lineages were examined by using conditions as described above, respectively.

For macrophage differentiation, three colony-derived cells were treated with M-CSF plus HSC-Brew GMP Basal Medium for 2-3 days. For RPE cell differentiation, six colony-derived cells were treated with the RtEGM™ Retinal Pigment Epithelial Cell Growth Medium BulletKit™ (Lonza) for 3-5 days. For neuronal differentiation, the single colony-derived cells (total n=9 colonies) were treated with 100 ng/mL neuronal growth factor (NGF, R & D Systems) plus human neuronal stem cell growth medium (iXCells Biotechnologies, San Diego, CA, USA) in 96-well plates for 2-3 days. Their differentiations were evaluated with lineage-specific markers such as the phagocytosis of fluorescent latex beads for macrophage differentiation, RPE65 immunostaining for REP cells, and Synapsin I immunostaining for neuronal cells. Untreated colony-derived cells served as controls. Additionally, to determine their phenotype, the single-colony-derived cells (n=3 colonies) were tested by flow cytometry with leukocyte common antigen CD45, HSC marker CD34, ES cell marker SOX2, together with memory cell marker CD45RO and CCR7. Isotype-matched IgGs served as a control for flow cytometry.

To determine the multipotent differentiations of miPB-IPC, an initial colony analysis was performed with three-germ layer-associated markers, including a neuronal marker synapsin for ectoderm, an islet β cell marker insulin for endoderm, and a macrophage marker CD11b for mesoderm. Additionally, using a 3-germ layer immunocytochemistry kit (Invitrogen, Carlsbad, CA, USA), further colony analysis was performed using a Human Definitive Pancreatic Endoderm Analysis kit with additional three-germ layer-associated markers, including a neuronal marker beta III tubulin (Tuj1) for ectoderm, a liver cell marker alpha-fetoprotein (AFP) for endoderm, and smooth muscle actin (SMA) for mesoderm. For immunostaining, colonies were fixed and permeabilized in 24-well plates and followed by immunostaining as described above. IgGs served as negative controls.

G. Tumor Formation Assay

To determine the potential of tumor formation of miPB-IPC, the miPB-IPC were subcutaneously inoculated in the right flank of NSG mice ($2×10^7$ cells per mouse in 200 µL physiological saline, S.C., right lower flank, n=3 mice), according to the approved animal protocol at Hackensack Meridian Health. Injection of equal volume of physiological saline on the left lower flank served as a control. Tumor formation and body weight were monitored once a week for 12 weeks. At the end of the observations, the liver, lung, spleen, and kidney tissues of miPB-IPC-treated mice were inspected and collected for histopathological examinations on tumor formation.

H. Tracking RFP-Labeled Mitochondria in PB-IPC

To directly examine the penetration of red fluorescent protein (RFP)-labeled mitochondria into PB-IPC, RFP-labeled mitochondria were purified from an HEK-293 cell line after being labeled with CellLight™ Mitochondria-RFP BacMam 2.0 (Thermo Fisher Scientific, Waltham, MA, USA), according to manufacturer's recommended protocol. PB-IPC were initially plated in 12 mm Nunc Glass Base Dish (Thermo Fisher Scientific) in NutriStem® hPSC XF culture medium. After attaching for one hour, PB-IPC were treated with the purified RFP-labeled mitochondria in X-VIVO™ 15 medium (Lonza). After the treatment for 4 hours, the treated PB-IPC were photographed by using confocal microscopy. Hoechst 33,342 were applied to stain the nucleus of viable cells.

I. Transmission Electron Microscopy (TEM)

To determine the penetration of mitochondria into nuclei, PB-IPC were treated with 100 µg/mL of platelet-derived mitochondria for 12 hours, at 37° C. in 8% $CO_2$. Consequently, the mitochondrion-treated and untreated PB-IPC were collected at 500 g×5 min and fixed with 2.5% glutaraldehyde/4% paraformaldehyde in 0.1 M Cacodylate buffer for transmission electron microscope (Philips CM12 electron microscope with AMT-XR11 digital camera) analysis. Alternatively, the purified viable nuclei were labeled with Hoechst 33,342 and were incubated with MitoTracker Deep Red-labeled mitochondria. Their interactions were directly observed and photographed under confocal microscope.

J. Blocking Experiment with CXCR4 Receptor Antagonist AMD 3100

To determine whether the action of SDF-1/CXCR4 contributed to the penetration of mitochondria into nuclei, a blocking experiment with CXCR4 receptor antagonist AMD3100 was performed. The purified PB-IPC's nuclei were treated with MitoTracker Deep Red-labeled purified mitochondria in the presence or absence of AMD 3100 (30 µM). The equal concentration of solvent DMSO served as a control. After 4 hours of the treatment, nuclei were washed twice with PBS and prepared for flow cytometry.

K. Quantitative Real Time PCR

To clarify the interaction of mitochondria and nuclei, PB-IPCs' nuclei were isolated using Nuclei isolation kit (Sigma) according to the manufacturer's recommended protocol. PB-IPCs' nuclei were treated with 100 μg/mL platelet-derived mitochondria for 4 hours, at 37° C. in 8% $CO_2$. Consequently, the mitochondrion-treated and untreated nuclei were collected at 500 g×5 minutes and fixed with 2.5% glutaraldehyde/4% paraformaldehyde in 0.1 M cacodylate buffer for electronic microscope. Additionally, $RT^2$ Profiler real time PCR Array was applied to study the directly genetic and epigenetic modulations of mitochondria by using the Human Epigenetic Chromatin Modification Enzymes kit (96-well format, Qiagen, Valencia, CA, USA). $RT^2$ Profiler real time PCR Array was used according to the manufacturer's instructions. The data were analyzed using PrimePCR array analysis software (Bio-Rad, Hercules, CA, USA).

To detect the expression of human islet β-related gene markers by quantitative real time PCR, PB-IPC were isolated from culture vessels after attachment at different time points such as 6, 12, 24, 48, and 72 hours. Total RNAs from each sample were extracted using a Qiagen kit (Valencia, CA, USA). First-strand cDNAs were synthesized from total RNA using an iScript gDNA Clear cDNA Synthesis Kit according to the manufacturer's instructions (Bio-Rad, Hercules, CA, USA). Real-time PCR was performed on each sample in triplicate using the StepOnePlus Real-Time PCR System (Applied Biosystems, CA, USA) under the following conditions: 95° C. for 10 minutes, then 40 cycles of 95° C. for 15 seconds, and 60° C. for 60 seconds, using the validated gene-specific PCR Primer sets for each gene including pancreatic islet cell-related markers including insulin (Bio-Rad Laboratories, Hercules, CA, USA), MAFA, NKX6.1, and PDX-1 (Qiagen, Valencia, CA, USA). The expression level of each gene was determined relative to β-actin as an internal control. To confirm gene expression, real time PCR products were examined with 1.5% agarose gel electrophoresis.

L. RNA-Sequencing (RNA-seq)

RNA sequencing (RNA-seq) analysis was performed between the mitochondrion-treated and untreated PB-IPC in four preparations. Total RNAs from each sample were extracted using a Qiagen kit (Valencia, CA, USA) and shipped to Genewiz (South Plainfield, NJ, USA) in dry ice for standard RNA sequencing and profiling gene expression by using Illumina NovaSeq™ 6000 Sequencing System (Genewiz, South Plainfield, NJ, USA), with 2×150 bp configuration, single index, per lane.

M. Statistics

Statistical analyses of data were performed by the two-tailed paired Student's t-test to determine statistical significance between untreated and treated groups. Values were given as mean±SD (standard deviation).

IV. Materials and Methods for Generation of Hematopoietic-Like Stem Cells from miPB-IPC A. PB-IPC Cell Culture Human buffy coat blood units (n=51; mean age of 48.97±14.11; age range from 18 to 72 years old; 24 males and 27 females) were purchased from the New York Blood Center (New York, NY, USA). Human buffy coats were initially added to 40 mL of chemical-defined, serum-free culture X-VIVO™ 15 medium (Lonza, Walkersville, MD, USA), mixed thoroughly with a 10 mL pipette, and then used for isolation of peripheral-blood-derived mononuclear cells (PBMCs). PBMCs were then harvested. The mononuclear cells were isolated from buffy coat blood using Ficoll-Paque™ PLUS (γ=1.007, GE Healthcare, Chicago, IL, USA), followed by removing red blood cells using a red blood cell lysis buffer (eBioscience, San Diego, CA, USA). After three washes with saline, the whole PBMCs were seeded in 150×15 mm Petri dishes (BD Falcon, NC, USA) at 1×10⁶ cells/mL, 25 mL/dish in chemical-defined, serum-free culture X-VIVO™ 15 medium (Lonza, Walkersville, MD, USA) without any other added growth factors, and incubated at 37° C. in 8% $CO_2$. Seven days later, PB-IPCs were growing and expanded by adhering to the hydrophobic bottom of Petri dishes. Subsequently, PB-IPCs were washed three times with saline, and all floating cells were removed. Next, serum-free NutriStem® hPSC XF culture medium (Corning) was added to continue the cell culture and expansion at 37° C. in 8% $CO_2$. The expanded PB-IPCs were utilized for experiments within 7-14 days.

B. Isolation of Mitochondria from Platelets

Mitochondria were isolated from peripheral blood (PB) platelets using a Mitochondria Isolation kit (Thermo Scientific, Rockford, IL, USA, Prod: 89874) according to the manufacturer's recommended protocol. Adult human platelet units (n=16; mean age of 30.81±8.64; age range from 16 to 40 years old; 9 males and 7 females) were purchased from the New York Blood Center (New York, NY, USA). The concentration of mitochondria was determined by the measurement of protein concentration using a NanoDrop 2000 Spectrophotometer (ThermoFisher Scientific, Waltham, MA, USA). The isolated mitochondria were aliquoted and kept in a −80° C. freezer for experiments.

For mitochondrial staining with fluorescent dyes, mitochondria were labeled with MitoTracker Deep Red FM (100 nM) (Thermo Fisher Scientific, Waltham, MA, USA) at 37° C. for 15 minutes according to the manufacturer's recommended protocol, followed by two washes with PBS at 3000 rpm×15 minutes.

C. In Vitro Differentiation of PB-IPCs into miCD34+ HSCs

PB-IPCs were treated with 100 μg/mL platelet-derived mitochondria for 7-14 days in non-treated 24-well plates or Petri dishes with serum-free NutriStem® hPSC XF culture medium (Corning, New York, NY, USA), at 37° C. and 8% $CO_2$. According to our current protocol, mitochondrion-induced CD34+ hematopoietic-like stem cells (miCD34⁺ HSCs) were purified from mitochondria-treated PB-IPCs by immunomagnetic sorting with Miltenyi Biotech CD34 MicroBead Kit (Miltenyi Biotech, Gladbach, Germany, catalog #130-097-047) according to the manufacturer's instructions. The differentiation of miCD34⁺ HSCs was characterized by flow cytometry.

D. Flow Cytometry

Flow cytometric analyses of surface and intracellular markers were performed. PB-IPCs were washed with PBS at 2000 rpm for 5 minutes. Mitochondria were washed with PBS at 12,000 g for 10 minutes at 4° C. Samples were pre-incubated with human BD Fc Block (BD Pharmingen, Franklin Lakes, NJ, USA) for 15 minutes at room temperature and then directly aliquoted for different antibody staining. Cells were incubated with different mouse anti-human monoclonal antibodies (mAb). For surface staining, cells were stained for 30 minutes at room temperature and then washed with PBS at 2000 rpm for 5 minutes prior to flow analysis. Isotype-matched mouse anti-human IgG antibodies (Beckman Coulter, Brea, CA, USA) served as a negative control for all fluorescein-conjugated IgG mAb. SYTO™60 (Thermo Fisher, Waltham, MA, USA) was combined with CD235a (GLY-A) staining to determine the nucleated erythroid cells. Staining with propidium iodide (PI) (BD Biosciences, San Jose, CA, USA) was used to exclude dead cells during flow cytometry analysis. For intracellular staining, cells were fixed and permeabilized according to PerFix-nc kit (Beckman Coulter) manufacturer's recommended protocol. After staining, cells were collected and analyzed using a Gallios Flow Cytometer (Beckman Coulter, Brea, CA, USA) equipped with three lasers (488 nm blue, 638 red, and 405 violet lasers) for concurrent reading of up to 10 colors. The final data were analyzed using the Kaluza Flow Cytometry Analysis software version 2.1 (Beckman Coulter).

Cells were incubated with different mouse anti-human monoclonal antibodies (mAb) from Beckman Coulter (Brea, CA, USA), including FITC-conjugated anti-CD45RA, anti-IFNγ, anti-CD4, anti-CD235a, anti-CD8 and anti-CD42a; phycoerythrin (PE)-conjugated anti-CD34; PE-Texas Red-conjugated CD3; phycoerythrin-Cy5 (PE-Cy5)-conjugated anti-CD90; phycoerythrin-Cy5.5 (PE-Cy5.5)-conjugated anti-CD19; phycoerythrin-Cy7 (PE-Cy7)-conjugated anti-CD49f, anti-CD11b and anti-CD45; APC-conjugated anti-CD4; APC-Alexa Fluor 700-conjugated anti-CD71; APC-Alexa Fluor 750-conjugated anti-CD7, anti-CD66b and anti-CD8; Pacific blue (PB)-conjugated anti-CD38; Krome Orange-conjugated anti-CD14 and anti-135 (FLT3)-BV510. From BD Biosciences (San Jose, CA, USA), the investigators purchased the AlexaFluor-488-conjugated anti-human Cytochrome C; FITC-conjugated anti-CD90 (THY1) and anti-CD11C; BV 510-conjugated anti-CD45, PE-conjugated anti-IL4, anti-IL5, anti-BAH1, anti-IL12; PE-CF594-conjugated anti-CD10, BV421-conjugated anti-CD209 and PE-conjugated anti-mouse CD45.1. Antibodies were purchased from Biolegend (San Diego, CA, USA) including the FITC-conjugated anti-human Hsp60, anti-human TCRαβ, anti-human Notch 1 and anti-human Notch 2; PE-conjugated anti-human Notch 3, anti-human Dll1, anti-human Dll4 and anti-human Jagged2; APC conjugated anti-human Notch 4; phycoerythrin-Cy7 (PE-Cy7)-conjugated anti-TCRγδ and Pacific blue (PB)-conjugated anti-CD3. FITC-conjugated anti-human Jagged1 and PE-conjugated anti-human Dll3 mAbs were purchased from R&D Systems (Minneapolis, MN, USA). Hemoglobinβ/γ/δ (H-76) rabbit polyclonal antibody, AlexaFluor-546-conjugated Calnexin and AlexaFluor-647-conjugated GM130 were purchased from Santa Cruz Biotechnology (Dallas, TX, USA). SYTOTM60 was purchased from Thermo Fisher (Waltham, MA, USA).

E. Multiple Differentiations of miCD34+ HSCs

Initially, miCD34+ HSCs were purified from miPB-IPCs by using a CD34 MicroBead Kit, human-lyophilized (Miltenyi Biotec, Gladbach, Germany) through the auto MACS Pro Separator (Miltenyi Biotec, Gladbach, Germany) according to the manufacturer's recommended protocol. The purified miCD34+ HSCs were treated with different inducers for cellular differentiations.

To test T-cell differentiation, the purified miCD34+ HSCs ($1 \times 10^5$ cells/mL) were planted in 24-well non-treated plates in the presence of HSC-Brew GMP Basal Medium (Miltenyi Biotec, Gladbach, Germany) with the addition of cytokines 25 ng/ml hFlt3L and 25 ng/mL rhIL-7 (R&D Systems, Minneapolis, MN, USA), at 37° C. in 5% $CO_2$. After treatment for 3-7 days, cells were photographed and analyzed by confocal microscopy and flow cytometry using different T-cell markers such as CD3, CD4, CD8, TCR α/β, CD38, Th1 cytokines (IL-4 and IL-5) and Th2 cytokines (IFN-γ and IL-12). Untreated miCD34+ HSCs served as negative controls. T cells from healthy donors served as positive controls. For combined immunocytochemistry, the differentiated cells were fixed in 24-well plates with 4% paraformaldehyde for 20 minutes and permeabilized with 0.5% triton X-100 (Sigma, Saint Louis, MO, USA) for 5 minutes, blocking non-specific binding with 2.5% horse serum, and followed by immunostaining with FITC-conjugated mouse anti-human CD4 and CD8 (Beckman Coulter, Brea, CA, USA). After covering with mounting medium with DAPI (Vector Laboratories, Burlingame, CA, USA), cells were photographed with a Nikon AIR confocal microscope on a Nikon Eclipse Ti2 inverted base, using NIS Elements Version 4.60 software.

For differentiation of miCD34+ HSCs to macrophages, purified miCD34+ HSCs ($1 \times 10^5$ cells/mL) were treated with 50 ng/ml M-CSF (Sigma, St. Louis, MO, USA) in 24-well non-treated plates in the presence of HSC-Brew GMP Basal Medium, at 37° C. in 5% $CO_2$. After treatment for 2-3 days, cells were analyzed with phagocytosis and by flow cytometry with macrophage marker CD11b (Beckman Coulter, Brea, CA, USA) and CD209 (BD Biosciences, San Jose, CA, USA). Untreated miCD34+ HSCs served as negative controls. To detect the function of differentiated macrophages, fluorescent latex beads (Sigma, Saint Louis, MO, USA) were added to M-CSF-treated and untreated miCD34+ HSC cultures. After 4 hours of incubation with latex beads, cells were washed three times with PBS. Phagocytosis was viewed and evaluated under microscopy. The positive cells had a minimum of five beads per cell.

To differentiate miCD34+ HSCs into granulocytes, purified miCD34+ HSCs ($1 \times 10^5$ cells/mL) were treated with 25 ng/mL hFlt3L plus 100 ng/mL G-CSF (R&D Systems) in the presence of HSC-Brew GMP Basal Medium, in 24-well non-treated plates, at 37° C. in 5% $CO_2$. After the treatment for 3-5 days, cells were photographed and analyzed by flow cytometry with granulocyte marker CD66b and staining with Wright-Giemsa (Sigma, Saint Louis, MO, USA) according to the manufacturer's instructions. Untreated miCD34+ HSCs served as negative controls. PBMCs from healthy donors served as positive controls.

To differentiate miCD34+ HSCs into RBCs, purified miCD34+ HSCs ($1 \times 10^5$ cells/mL) were initially treated with 25 ng/ml hFlt3L plus 3 units/mL EPO (R&D Systems, Minneapolis, MN, USA) in the presence of HSC-Brew GMP Basal Medium, in 24-well non-treated plates, at 37° C. in 5% $CO_2$. After treatment for 5 days, cells were re-treated with 3 units/mL EPO for an additional 3-7 days. Subsequently, cells were photographed and analyzed by flow cytometry with erythrocyte markers CD235a and hemoglobin. Untreated miCD34+ HSCs served as negative controls. For intracellular flow cytometry, all floating cells were collected and centrifuged at 2700 g×15 minutes. First, after blocking non-specific binding with Fc Blocker (BD Biosciences, San Jose, CA, USA), cells were fixed and permeabilized using a PerFix-nc kit (Beckman Coulter, Brea, CA, USA) according to the manufacturer's recommended protocol. Second, cells were incubated with rabbit anti-human hemoglobinβ/γ/δ polyclonal antibody (Santa Cruze, Dallas, TX, USA) at 1:100 dilution at room temperature for 30 minutes and then washed with PBS at 2700 g×15 minutes. Next, cells were labeled with Cy5-conjugated AffiniPure donkey anti-rabbit 2nd Ab (Jackson ImmunoResearch Laboratories, West Grove, PA, USA), in combination with staining with mouse anti-human CD235a-FITC (Beckman Coulter, Brea, CA, USA) and CD45-PE-CY7 mAbs for 30 minutes, and followed by flow cytometry analysis.

To differentiate miCD34+ HSCs into megakaryocytes and platelets, purified miCD34+ HSCs ($1 \times 10^5$ cells/mL) were initially treated with 25 ng/ml hFlt3L+100 ng/ml TPO (R&D Systems, Minneapolis, MN, USA) in the presence of HSC-Brew GMP Basal Medium, in 24-well non-treated plates, at 37° C. in 5% $CO_2$. After this treatment for 3-7 days, cells were photographed and collected for flow cytometry with MK/platelet marker CD42a (Beckman Coulter, Brea, CA, USA). Untreated miCD34$^+$ HSCs served as negative controls. For analysis of polyploidization, viable TPO-treated miCD34$^+$ cells were first stained with CD42a mAb and Hoechst 33342 (Sigma, Saint Louis, MO, USA) and photographed under a confocal microscope. Secondly, using healthy donor-derived matured T cells (1N) and platelets (ON) as controls, the polyploidy of differentiated CD42a$^+$ MKs was analyzed by flow cytometry after staining with propidium iodide (PI) (Abcam, Cambridge, MA, USA) according to the manufacturer's recommended protocol.

To morphologically determine the differentiation of miCD34$^+$ HSCs to granulocytes, RBCs, and megakaryocytes/platelets, Wright-Giemsa staining was performed on the treated and untreated cells, which were then observed and photographed under an inverted Nikon ECLIPSE Ti2 microscope.

For a DAPT-blocking experiment, PB-IPCs were treated with 100 μg/mL mitochondria plus 10 μM DAPT (Sigma, Saint Louis, MO, USA, Catalog #D5942) for 7-14 days in non-tissue, culture-treated 24-well plates or Petri dishes with serum-free NutriStem® hPSC XF culture medium (Corning, New York, NY, USA), at 37° C. and 8% $CO_2$. Subsequently, both treated and untreated PB-IPC were collected to examine the expression of CD34 by flow cytometry.

F. Animal Study and Engraftment of miCD34+ HSCs into Irradiated NSG Mice

All animal experiments were performed according to approval of the Institutional Animal Care and Use Committee of Hackensack Meridian Health. To demonstrate the multipotent features of miCD34$^+$ HSCs, purified miCD34$^+$ HSCs were transplanted into irradiated NOD/Lt-scid/IL2R$\gamma^{null}$ (NSG) mice. NSG mice were purchased from Jackson Laboratories (Bar Harbor, ME, USA) and were bred and maintained under pathogen-free conditions at the animal facility of the Center for Discovery and Innovation.

To determine the repopulating potential of miCD34$^+$ HSCs, NSG mice, aged 12-16 weeks, were irradiated with 200 cGy using an RS-2000 irradiator (Rad Source Technologies, Suwanee, GA, USA). The miCD34$^+$ HSCs were transplanted into irradiated NSG mice at $3 \times 10^5$ cells/mouse via the tail vein (in 200 μL saline, i.v., n=10 mice) 24 hours after irradiation, according to a protocol approved by the Animal Care and Use Committee (ACC) of the Hackensack Meridian Health. Only physiological saline injection (200 μL) served as a control (n=6 mice). After transplantation, mice were monitored twice a week for 16 weeks. To examine the differentiation of miCD34$^+$ HSCs, mice were sacrificed at 12 or 16 weeks post-transplantation to collect samples of peripheral blood, the spleen, and bone marrow for flow cytometry analysis. To determine the multilineage differentiation of miCD34$^+$ HSCs after transplantation into irradiated NSG mice, only the viable cells from different samples were gated for analysis after excluding propidium iodide (PI)-positive dead cells. The gated human leukocyte common antigen CD45-positive and mouse CD45.1-negative viable cells were further analyzed for characterization with different human blood cell lineage-specific surface markers such as CD3 and CD4 for T cells; CD19 for B cells; CD41b for megakaryocytes/platelets; CD14, CD11b, and CD11c for monocytes/macrophages; CD66b for granulocytes; and CD235a for erythroid cells. SYTO60 was utilized to stain CD235a$^+$ nucleated erythroid cells. To determine T-cell populations and remove CD4$^+$ monocytes, anti-CD3 Ab was employed to gate out CD4$^+$ monocytes, in addition to the consideration of cell size difference. Isotype-matched IgGs served as controls for flow cytometry.

G. Statistics

Statistical analyses were performed with GraphPad Prism 8 (version 8.0.1) software. The normality test of samples was evaluated using the Shapiro-Wilk test. Statistical analyses of data were performed using the two-tailed paired Student's t-test to determine statistical significance between untreated and treated groups. The Mann-Whitney U test was utilized for non-parametric data. Values are given as mean±SD (standard deviation). Statistical significance was defined as p<0.05, two sided.

It is to be understood that while certain embodiments and/or aspects of the invention have been shown and described, the invention is not limited thereto and encompasses various other embodiments and aspects.

EXAMPLES

The following examples are provided to better illustrate the claimed invention and are not to be interpreted as limiting the scope of the invention. To the extent that specific materials are mentioned, it is merely for purposes of illustration and is not intended to limit the invention. One skilled in the art of the invention may develop equivalent means or reactants without the exercise of inventive capacity and without departing from the scope of the invention.

Example 1

Figure 4:
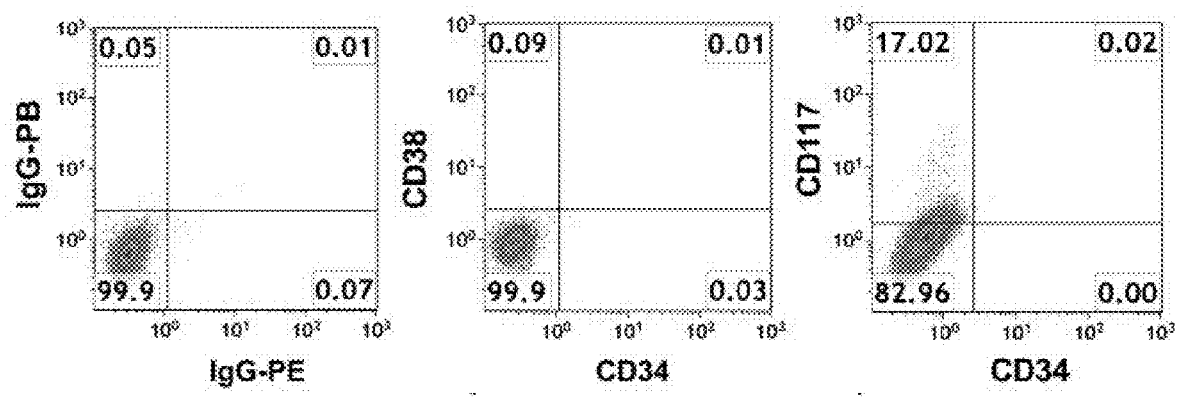
FIG. 4 shows flow cytometry graphs showing the phenotype of PB-IPC, with low expression of CD117, but no expression of CD4, CD8, CD19, CD34, CD38, CD41, CD42a, and CD66b. Isotype-matched IgGs served as controls (n=8).
Figure 5:
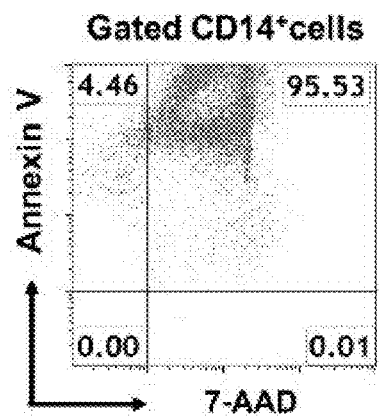
FIG. 5 illustrates apoptosis (Annexin V$^+$) and necrosis (7-AAD$^+$) of blood monocytes after 24-hour culture in non-tissue culture-treated Petri dishes (n=5).
Figure 6:
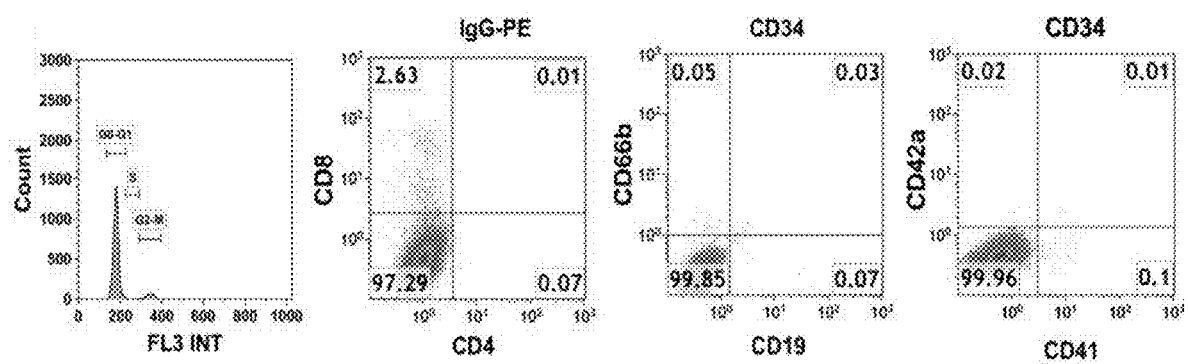
FIG. 6 shows analysis of cell cycles in the freshly-isolated PB-IPC after overnight attachment by flow cytometry with propidium iodide (PI) staining (n=5).

Adult Peripheral Blood-Derived PB-IPC Display Human Islet β Cell-Specific Markers FIGS. 3-10 illustrate the characterization of peripheral blood-derived insulin-producing cells (PB-IPC) from adult peripheral blood with islet β-cell-related markers. To characterize the specific marker of PB-IPC, PB-IPC were purified from adult peripheral blood by virtue of their ability to attach to the hydrophobic plastic surface of Petri dishes in serum-free culture medium. Flow cytometry demonstrated that PB-IPC displayed the phenotype of Lin$^-$CD34$^-$CD45$^+$ SOX2$^+$CD45 RO$^+$CCR7$^+$ (FIG. 3), including the expression of leukocyte common antigen CD45, memory cell markers CD45RO and CCR7, and embryonic stem (ES) cell marker SOX2, with low expression of CD117. In contrast, PB-IPC were negative for HSC markers CD34 and CD38; T cell markers CD3, CD4, and CD8; B cell marker CD19; granulocyte marker CD66b; and MK/platelet markers CD41 and CD42a (FIG. 4). CD14$^+$ monocytes/macrophages which could not adhere to the hydrophobic surface of culture vessels underwent apoptosis and/or necrosis within 24 hours of culture (FIG. 5). Additionally, cell cycles of the freshly-isolated PB-IPC were analyzed after overnight attachment by flow cytometry with propidium iodide (PI) staining. The data demonstrated that there was 0.9±0.5% of freshly-isolated PB-IPC distributed in the S phase, with 92.94±2.75% in $G_0/G_1$ phases and 6.68±2.2% in $G_2/M$ phases (FIG. 6). This indicates the limited potential of cellular proliferation for freshly-isolated PB-IPC. Thus, PB-IPC display a unique phenotype and are different from mesenchymal stem cells (MSC) and monocyte-derived stem cells (designated fibroblast-like macrophages, f-Mφ).

Figure 7:
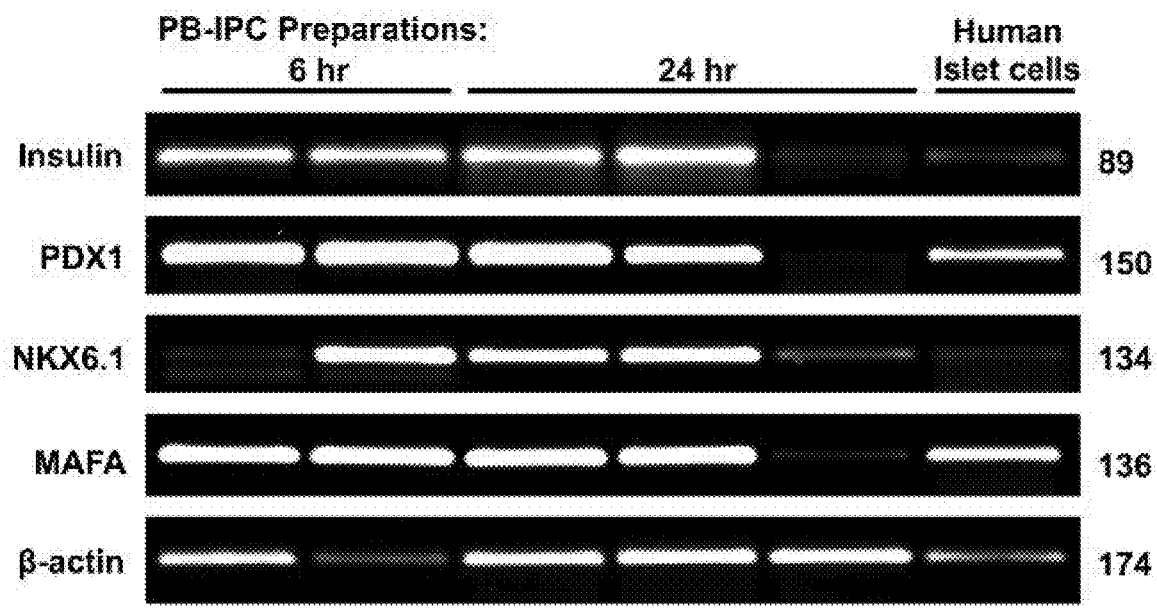
FIG. 7 shows real time PCR analysis of pancreatic islet β-cell-related markers in PB-IPC isolated from healthy donors (n=5). Freshly isolated human islets served as positive controls.
Figure 8:
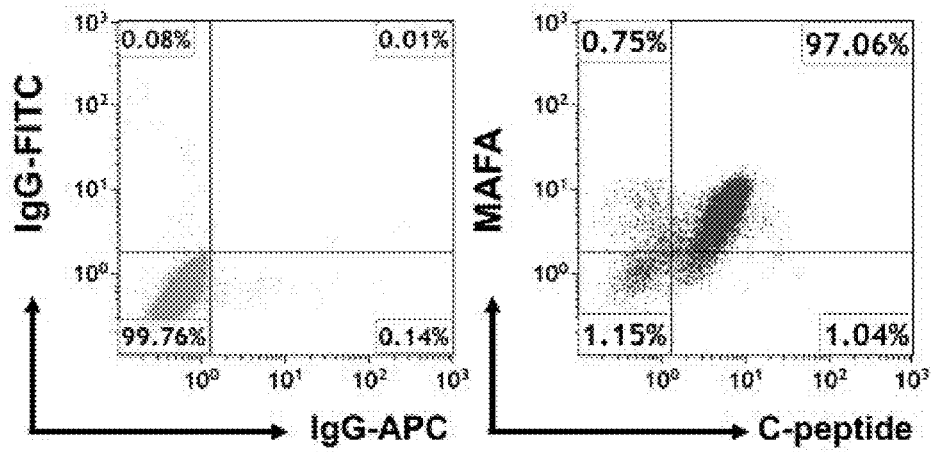
FIG. 8 shows flow cytometry for islet β-cell-related transcription factor MAFA and an insulin by-product C-peptide by double immunostaining (n=5).
Figure 9:
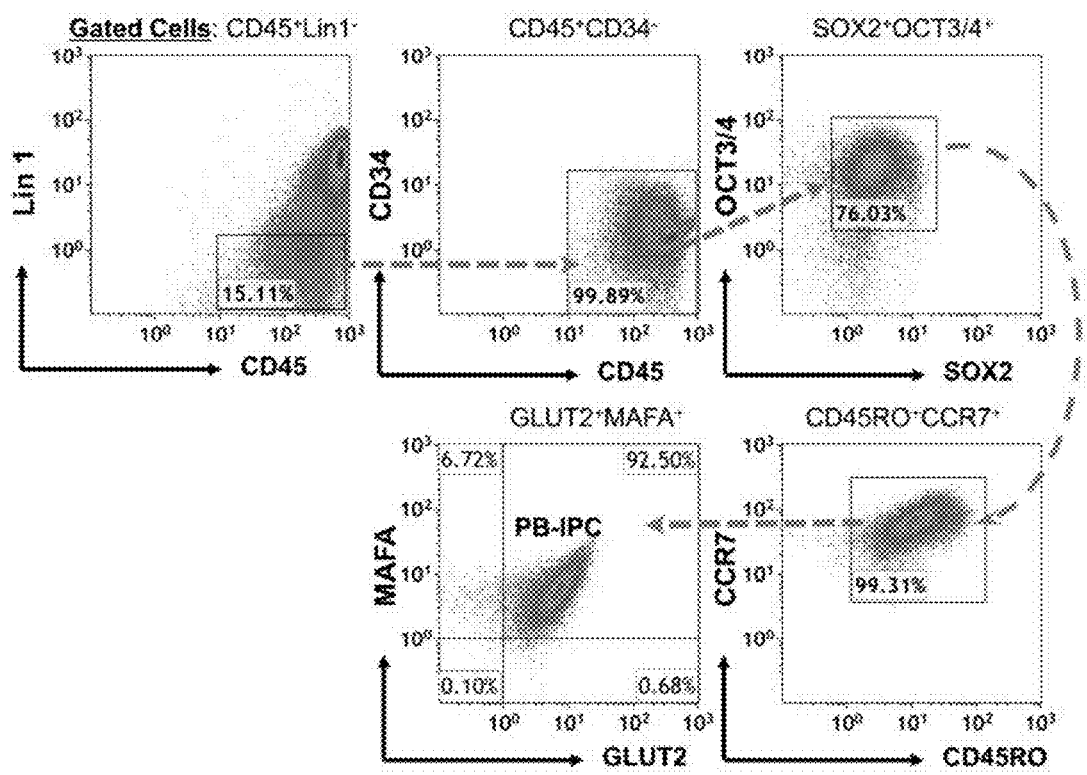
FIG. 9 shows flow cytometry for determining PB-IPC's phenotype after overnight attachment. Representative data shown from four preparations.
Figure 10:
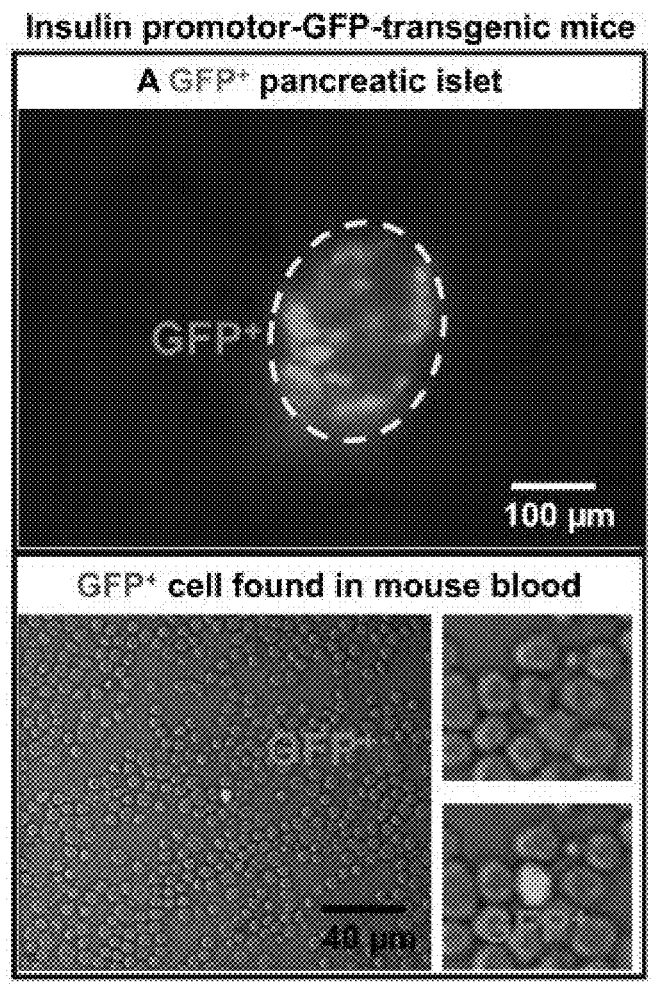
FIG. 10 is fluorescence microscopy imaging showing a GFP+ cell among PBMC of an insulin promotor 1-GFP-transgenic mouse (n=3). A GFP-positive mouse islet served as positive control.
Figure 11:
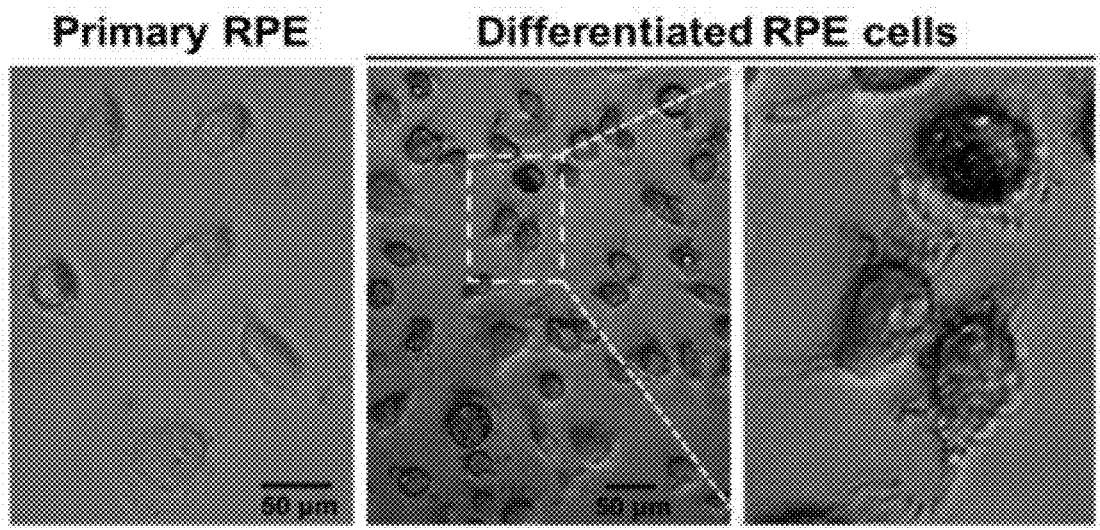
FIG. 11 is phase contrast imaging showing differentiation of miPB-IPC into RPE cells with cellular pigmentation and processes at varied lengths (n=5).

Next, insulin production of PB-IPC was analyzed. Using human islet cells as a positive control group, real time PCR data revealed that PB-IPC expressed human islet β cell-specific markers including insulin and transcription factor (PDX-1, NKX6.1, and MAFA) mRNAs (FIG. 7). Kinetic analysis demonstrated that these gene markers were stable in most PB-IPC samples within 24-hour ex vivo cultures of PB-IPC in the presence of serum-free X-VIVO™ 15 media, while some markers were disappeared or down-regulated, due to the potential different health statuses of blood donors. Flow cytometry further confirmed the double-positive cells with expressions of MAFA and C-peptide (a by-product of insulin) at protein levels (FIG. 8). Since MAFA is the only islet β cell-specific activator responsible for insulin expression and glucose transporter 2 (GLUT2) is a surface marker for human islet β cells, we further analyzed the percentage of PB-IPC in human peripheral blood mononuclear cells (PBMC) by using MAFA plus GLUT2 in combination with the above PB-IPC markers and an additional marker for an ES cell-associated transcription factor octamer-binding protein 3/4 (OCT3/4) and SRY-box containing gene 2 (SOX2). FITC-conjugated anti-human lineage cocktail 1 (Lin1) (CD3, CD14, CD16, CD19, CD20, CD56) was applied to eliminate the known cell lineages such as T cells, monocytes/macrophages, granulocytes, B cells, and natural killer (NK) cells. Anti-human leukocyte common antigen CD45 mAb was used to remove red blood cells (RBC) and platelets' contamination during data analysis. MAFA (transcription factor) and GLUT2 (β cell surface marker) were utilized to determine the islet β cell-associated phenotype in PB-IPC. Flow cytometry analysis indicated that there was 0.0045±0.004 of $Lin1^-CD34^-CD45^+CD45RO^+CCR7^+SOX2^+OCT3/4^+MAFA^+Glut2^+$ PB-IPC cells in freshly Ficoll Paque-isolated human PBMC. After overnight (12 hours) attachment selection, PB-IPC can be isolated from PBMC and display the same phenotype, with expression of $Lin1^-CD34^- CD45^+CD45RO^+CCR7^+SOX2^+OCT3/4^+ MAFA^+Glut2^+$ (FIG. 9). Additionally, GFP-positive insulin-producing cells were also found to be in the peripheral blood of insulin promotor-green fluorescence protein (GFP)-transgenic mice (The strain name: B6.Cg-Tg(Ins1-EGFP)1Hara/J, stock No: 006864) (FIG. 10). Therefore, these data established the existence of PB-IPC in peripheral blood that can be isolated by the current approach.

Example 2

Ex Vivo Differentiation of Mitochondrion-Induced PB-IPC (miPB-IPC) into Retinal Pigment Epithelium (RPE) Cells Platelets are enucleate cells without human genomic DNA. Apheresis platelets were obtained from New York Blood Center, with high purity (>99% of $CD41^+CD42^+$ platelets) for the following experimentation. The purity of isolated mitochondria was ≥90%.

Figure 12:
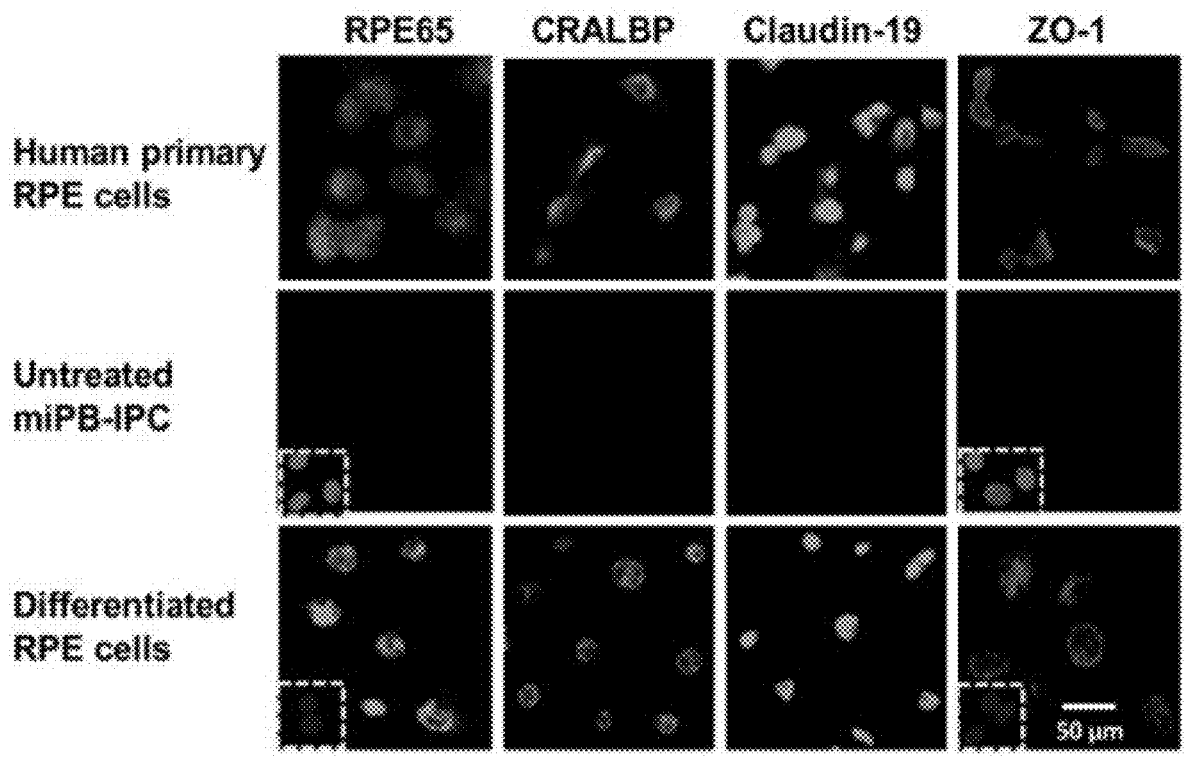
FIG. 12 shows immunostaining of differentiated RPE cells with RPE-specific markers (n=3). Human primary RPE cells served as positive controls. Mouse IgG and rabbit IgG merged with nuclear DAPI (blue) staining served as negative control (inserts). Untreated miPB-IPC served as negative control (middle panel).
Figure 13:
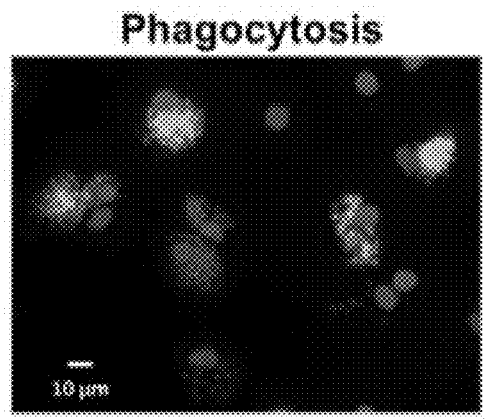
FIG. 13 illustrates phagocytosis of fluorescence beads by differentiated RPE cells (n=3).
Figure 14:
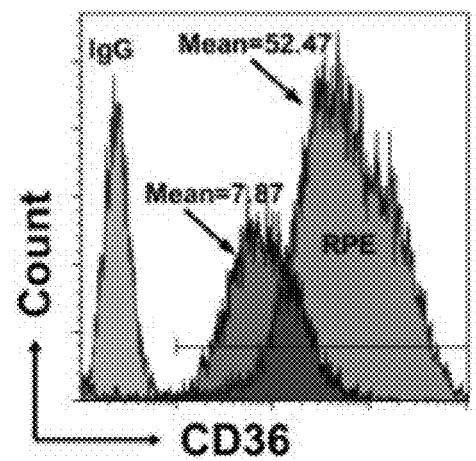
FIG. 14 shows flow cytometry analysis of CD36 expression on differentiated RPE cells and untreated cells (n=3). Isotype-matched IgG served as negative control.

Retinal pigment epithelium (RPE) is a monolayer cell that fundamentally supports visual function and the integrity of photoreceptors. Dysfunctions and loss of RPE cells is the major cause for age-related macular degeneration (AMD), leading to blindness. To determine whether miPB-IPC were multipotent, we tested their differentiation to RPE cells. FIGS. 11-14 illustrate differentiation of mitochondrion-induced PB-IPC (miPB-IPC) into retinal pigment epithelium (RPE) cells. Treatment with combined supplements (including L-glutamine, Gentamicin sulfate-Amphotericin (GA-1000), and basic fibroblast growth factor) in the presence of RPE growth media for 8 days caused >90% of miPB-IPC to acquire the RPE phenotype. Such RPE phenotype included pigmented granules in the cytoplasm, numerous cell processes at various lengths (FIG. 11), and expression of visual cycle proteins RPE65 and cellular retinaldehyde binding protein (CRALBP). It further included tight junction-associated membrane proteins claudin-19 and Zonular occludens-1 (ZO-1) (FIG. 12, bottom), similar to primary human RPE cells (FIG. 12, top). Functional analysis yielded a strong phagocytosis of fluorescence beads (FIG. 13) and an up-regulated expression of phagocytic marker CD36 (FIG. 14), similar to human RPE cells. Untreated cells acted as a control and failed to show these changes. These results indicated differentiated RPE cells which acquired the phenotype of human RPE cells.

Example 3

Figure 15:
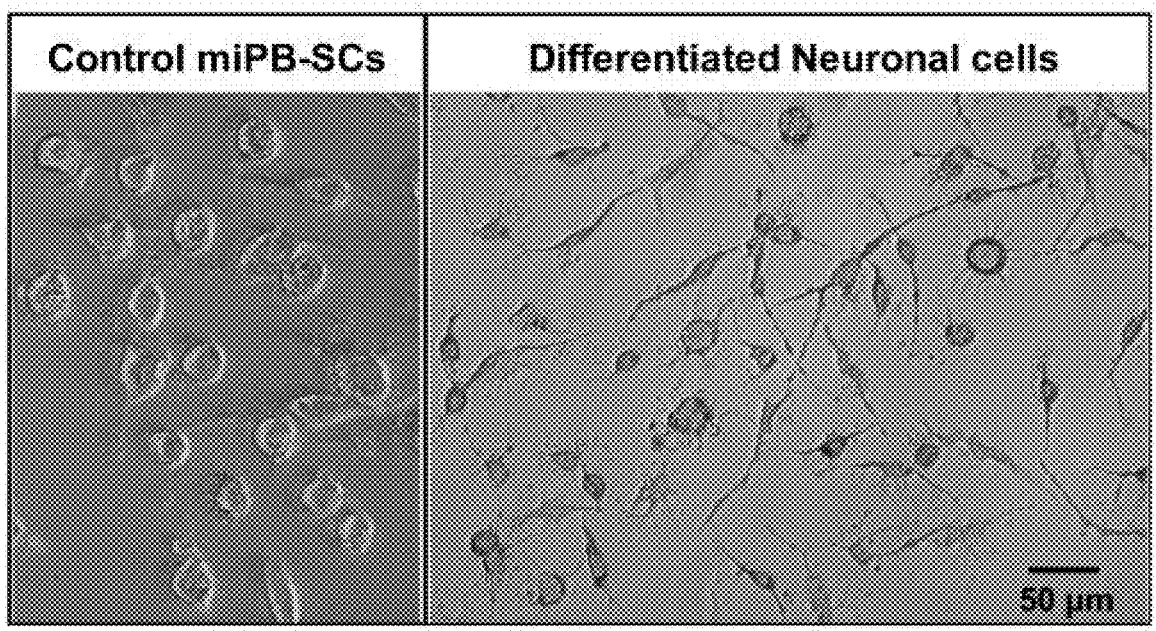
FIG. 15 is phase contrast imaging showing differentiation of miPB-IPC into neuronal cells (n=5).
Figure 16:
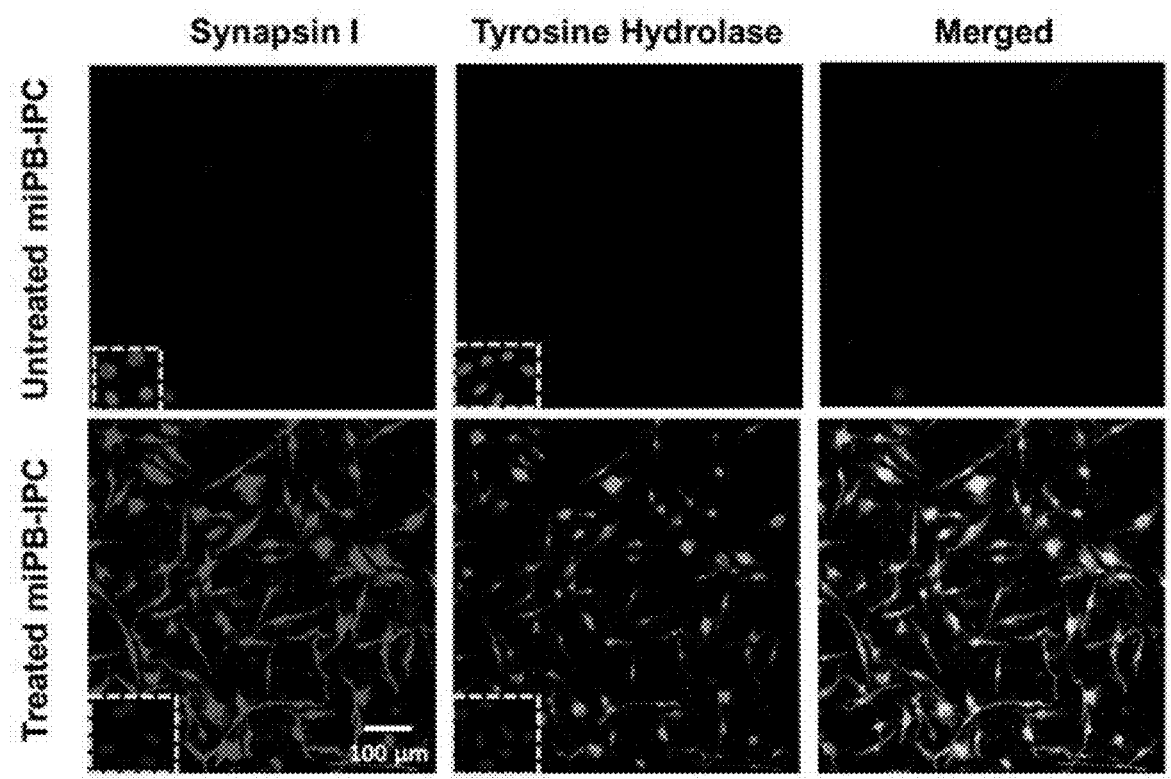
FIG. 16 shows immunostaining of differentiated neuronal cells with neuron-specific markers synapsin I and tyrosine hydroxylase (n=3). IgG staining served as negative control (inserts). Untreated miPB-IPC served as negative control (top panel).
Figure 17:
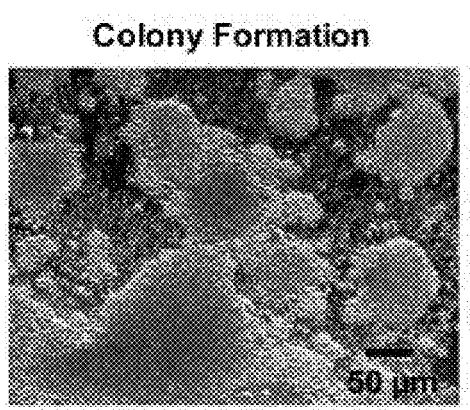
FIG. 17 illustrates colony formation of miPB-IPC with different sizes in regular miPB-IPC cell cultures (n=5).

Ex Vivo Differentiation of Mitochondrion-Induced PB-IPC (miPB-IPC) into Neuronal Cells During the induction of RPE cell differentiation, a few elongated neuronal-like cells were observed. Accordingly, the differentiation potential of miPB-IPC to neuronal cells was investigated. FIGS. 15-16 illustrate differentiation of miPB-IPC into neuronal cells. After treatment with 100 ng/mL neuronal growth factor (NGF) plus human neuronal stem cell growth medium in 24-well plates for 2-3 days, 99% of treated miPB-IPC displayed typical neuronal morphology including elongated axon-like processes with branches and formed cell-cell networks via dendrites (FIG. 15). Double-immunostaining revealed that 99.1% of treated cells expressed the neuronal-specific marker synapsin I and tyrosine hydroxylase (FIG. 16), a rate-limiting enzyme for the biosynthesis of catecholamines (e.g., dopamine and norepinephrine). Untreated cells only showed a spontaneous differentiation (<3%). These data indicate the adrenergic-neuronal differentiation potential of miPB-IPC.

Example 4

Clonal Analysis of miPB-IPC

Figure 18:
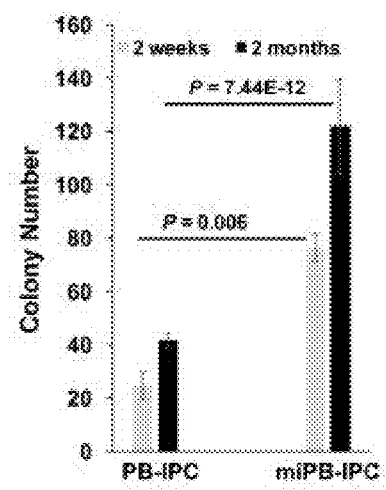
FIG. 18 is a graph showing potential difference in colony formation between miPB-IPC relative to untreated PB-IPC. Data are presented as mean±SD from five preparations.
Figure 19:
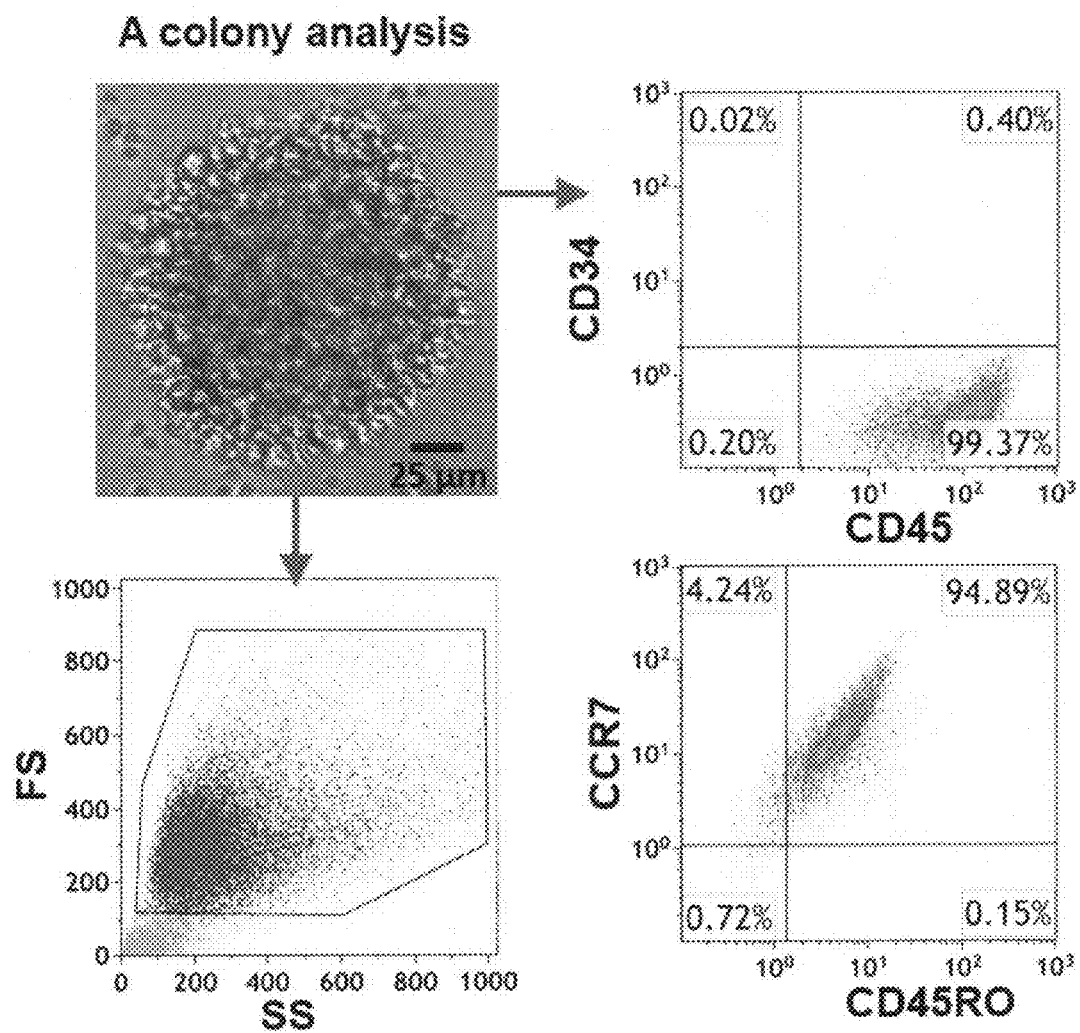
FIG. 19 shows phenotypic analysis of single colony-derived cells, retaining PB-IPC markers CD34−CD45+ SOX2+CD45RO+CCR7+ (n=5).
Figure 20:
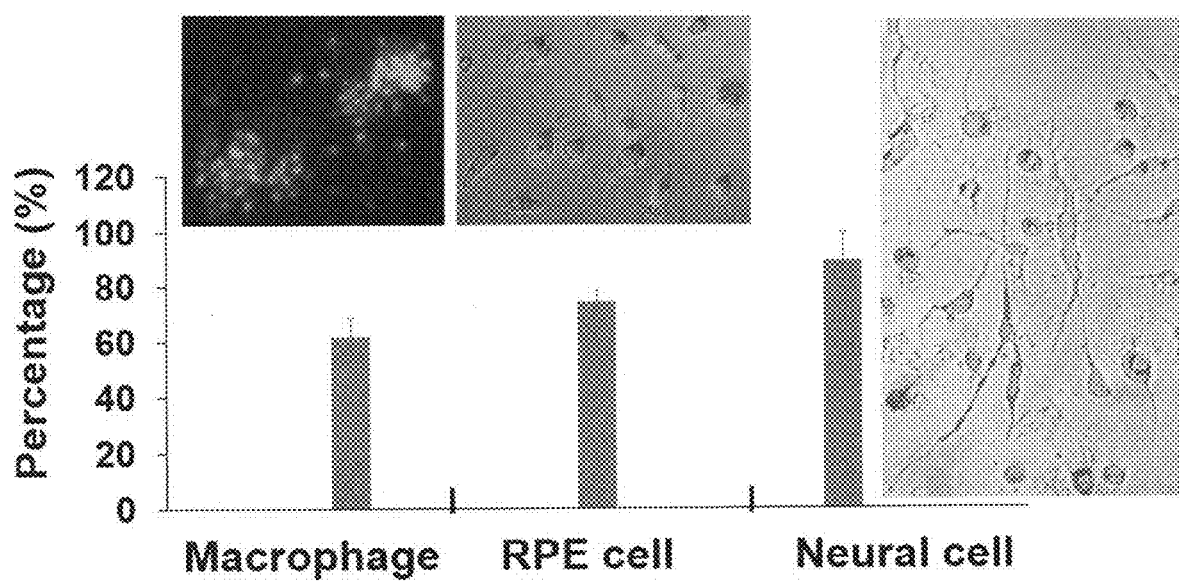
FIG. 20 shows clonal analysis. A single colony was dispersed and inoculated into 96-well plates, treated wells with different lineage-specific inducers for differentiations, including macrophages (left, phagocytosis of fluorescent beads, n=3), RPE cells (middle, n=6), and neural cells (right, n=9).
Figure 21:
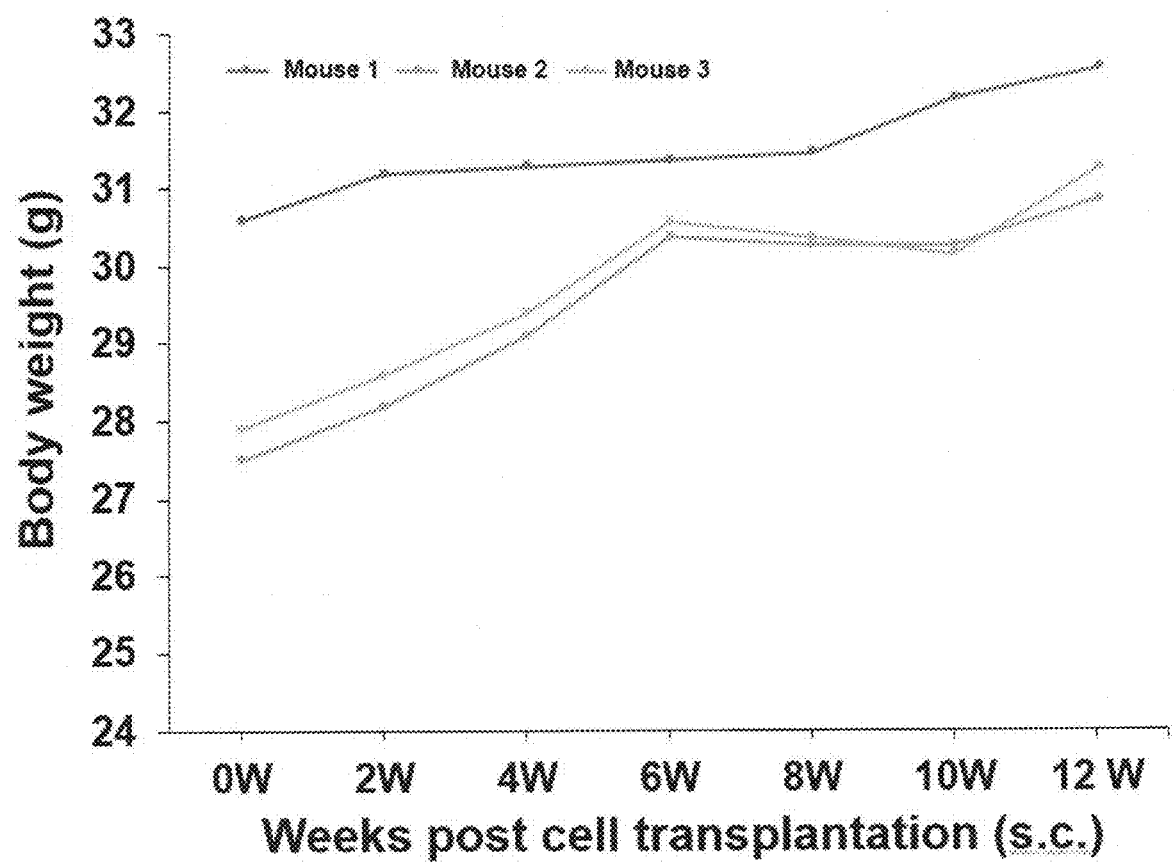
FIG. 21 illustrates weight gain in miPB-IPC-transplanted mice, without tumor formation. The miPB-IPC at a dose of 2×10$^7$ cells/mouse were inoculated (s.c., right lower flank) in NOD-scid IL-2Rγ$^{null}$ mice (n=3). Injection of equal volume of physiological saline on the left lower flank served as control.

To further determine the multipotency of miPB-IPC, clone analysis was performed. FIGS. 17-23 illustrate the clonal analysis of miPB-IPC and testing for tumor formation of miPB-IPC. Colony formation of miPB-IPC was observed with different sizes (FIG. 17), and the potential for colony formation of miPB-IPC was markedly increased after treatment with mitochondria relative to untreated PB-IPC (FIG. 18). Colony formation of miPB-IPC had occurred in different sizes at a 2-month culture in a 24-well plate. The miPB-IPC were initially cultured with serum-free NutriStem® hPSC XF culture medium (Corning) at $1\times10^4$ cells/mL/well in 24-well tissue culture plates, at 37° C. in 8% $CO_2$ culture conditions. Data are presented as mean±SD from five preparations. Flow cytometry verified that these colonies retained PB-IPC markers $CD45^+$ and $CD34^-$ (94.7±4.29%, n=3), $SOX2^+$ (77.38±13.34%), and $CD45RO^+$ and $CCR7^+$ (92.4±3.6%) (FIG. 19). Five colonies were dispersed and inoculated into 96-well plates. After treatment with different lineage-specific inducers including 50 ng/ml M-CSF for macrophage differentiation, 100 ng/mL NGF for neuronal cells, and RPE cells with specific condition medium, characterization of different lineage markers substantiated that 62.05±6.43% of differentiated Mφ exhibited phagocytosis of fluorescence beads (FIG. 20, left), 75.6±4.8% of differentiated RPE cells were RPE65-positive (FIG. 20, middle), and 94.8±1.7% of differentiated neuronal cells were synapsin I-positive (FIG. 20, right), each with distinctive morphologies. Untreated cells showed minimal spontaneous differentiation (<5%). These data demonstrate that single-colony-derived cells can give rise to different cell lineages such as macrophages, RPE cells, and neuronal cells, confirming the multipotent nature of miPB-IPC.

Additional study confirmed there was no tumor formation after transplant of miPB-IPC at the dose of $2 \times 10^7$ cells/mouse (s.c.). The miPB-IPC-transplanted mice gained weight at the time of a 12-week follow-up (FIG. 21, n=3 mice), without evident tumor formation upon tissue inspection (lung, liver, spleen, and kidney), indicating the safety of the miPB-IPC application.

Figure 22:
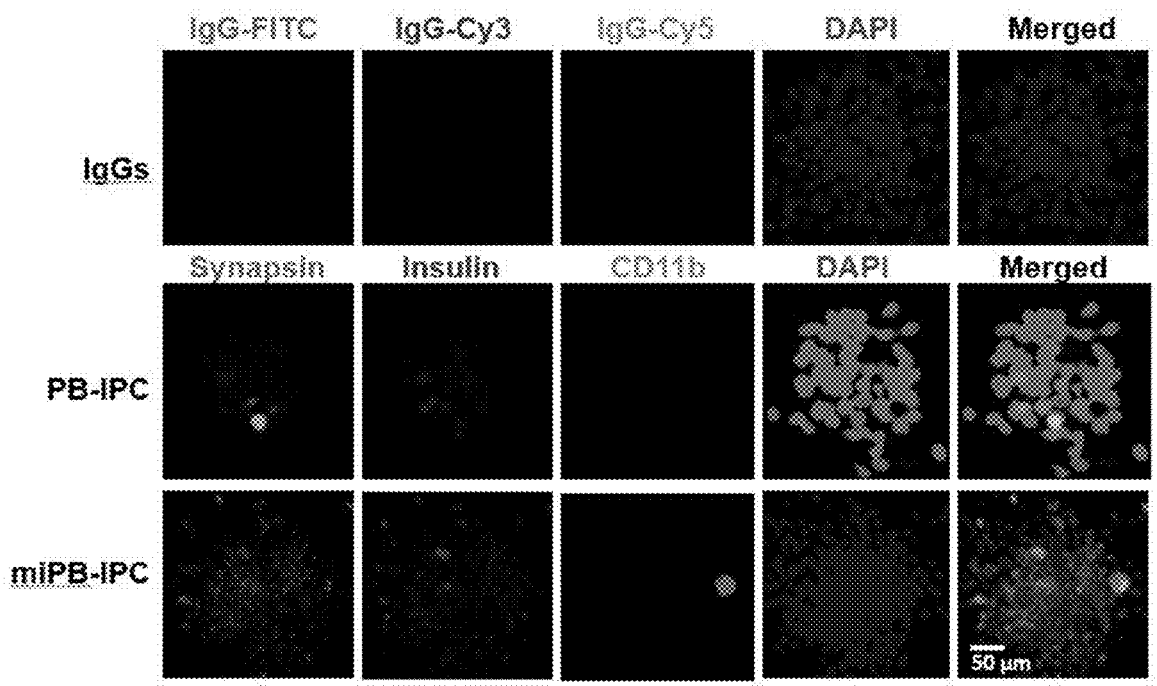
FIG. 22 is colony analysis imaging with three-germ layer-associated markers (neuronal marker synapsin I for ectoderm, islet β cell marker insulin for endoderm, and macrophage marker CD11b for mesoderm). IgGs served as negative controls (top panel). Representative images were from one of eight colonies for miPB-IPC group (bottom panel) and five colonies for control PB-IPC (middle panel).
Figure 23:
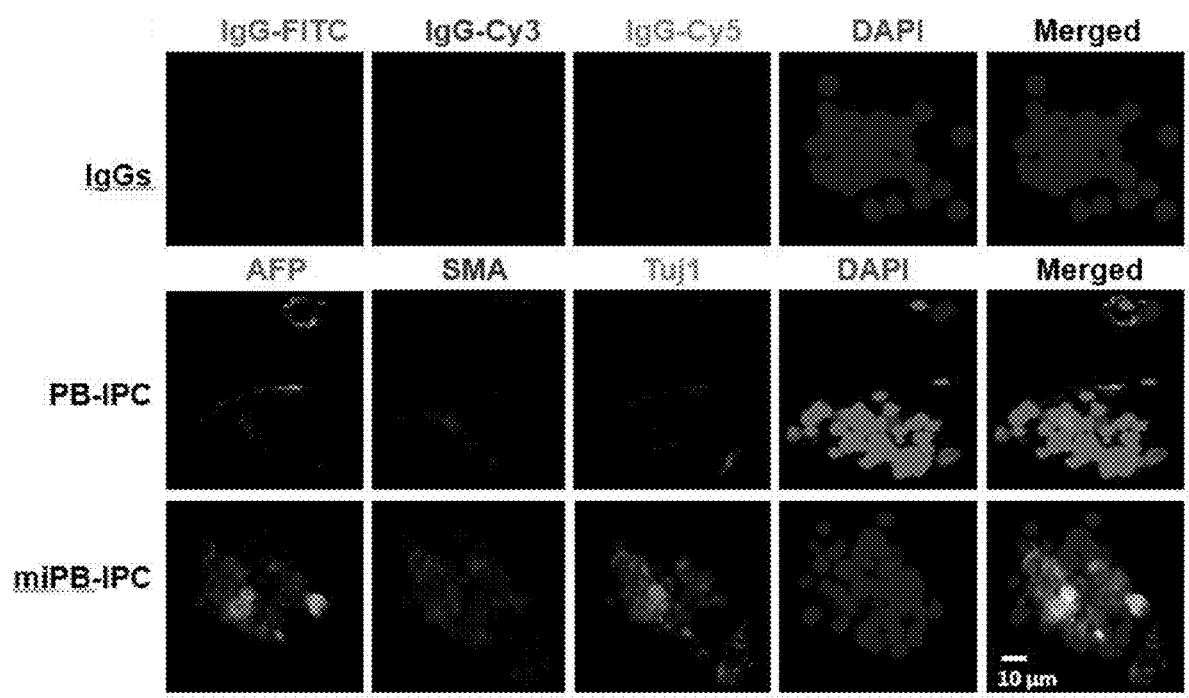
FIG. 23 is colony analysis imaging with additional three-germ layer-associated markers (neuronal marker beta III tubulin (Tuj1) for ectoderm, liver cell marker alpha-fetoprotein (AFP) for endoderm, and smooth muscle actin (SMA) for mesoderm). IgGs served as negative controls (top panel). Representative images were from one of seven colonies for miPB-IPC group (bottom panel) and five colonies for control PB-IPC (middle panel).
Figure 24:
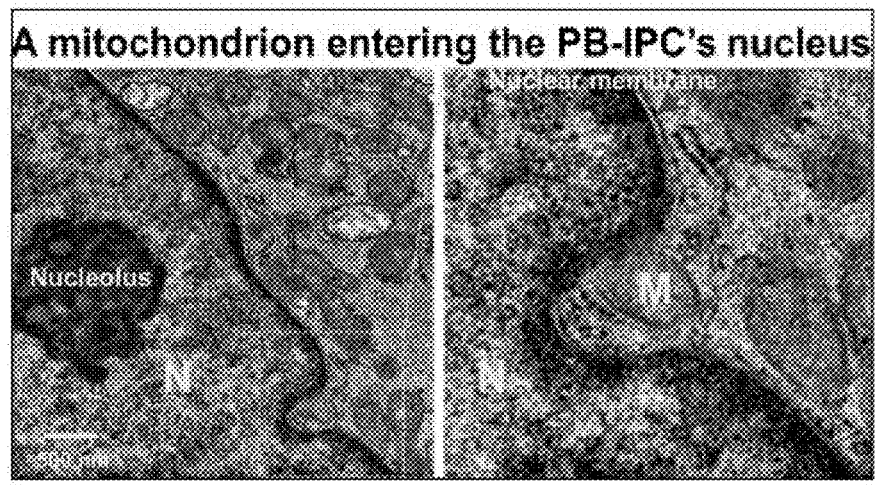
FIG. 24 is transmission electron microscopy imaging showing a mitochondrion (M) crossing the nuclear membrane of a mitochondrion-treated PB-IPC.

To determine the multipotent differentiations of miPB-IPC, colony analysis with three-germ layer-associated markers was performed, including a neuronal marker synapsin for ectoderm, the islet β cell marker insulin for endoderm, and a macrophage marker CD11b for mesoderm. Confocal microscopy demonstrated that there were more three-germ layer-positive cells distributed in miPB-IPC-derived colonies than those in mitochondrion-untreated PB-IPC-derived colonies (FIG. 22). Using the three-germ layer immunocytochemistry kit (Invitrogen), colony analysis was repeated with additional three-germ layer-associated markers, including a neuronal marker beta III tubulin (Tuj1) for ectoderm, the liver cell marker alpha-fetoprotein (AFP) for endoderm, and smooth muscle actin (SMA) for mesoderm. The data confirmed spontaneously differentiated three-germ layer-positive cells in miPB-IPC-derived colonies (FIG. 23). The number of positive cells was very low or negative in the mitochondrion-untreated PB-IPC-derived colonies (FIG. 23). Thus, the data showed multipotency of miPB-IPC.

Example 5

Penetration of Mitochondria into Nuclei of PB-IPC

Figure 25:
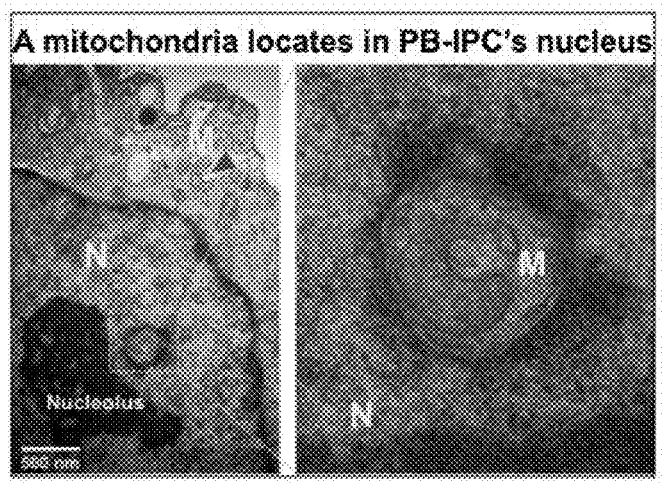
FIG. 25 is transmission electron microscopy imaging showing a mitochondrion located inside the nuclear matrix and close to the nucleolus with a morphologically-similar mitochondrion (indicated by arrow) in the cytoplasm.
Figure 26:
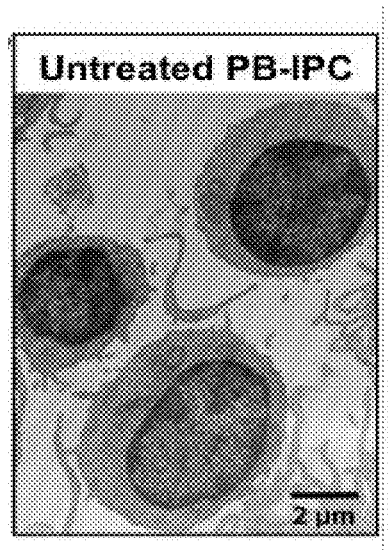
FIG. 26 shows the ultrastructure of untreated PB-IPC.
Figure 27:
FIG. 27 illustrates the penetration of red fluorescent protein (RFP)-labeled mitochondria into PB-IPC. After PB-IPC were treated with RFP-labeled mitochondria for 4 h, confocal microscopy established RFP+ mitochondria infiltrating the cytoplasm (n=5). Distribution of RFP+ mitochondria inside of a nuclear was represented by an arrow. RFP+ mitochondria were colocalized with Hoechst 33342-labeled nuclear and the differential interference contrast (DIC) image (left).
Figure 28:
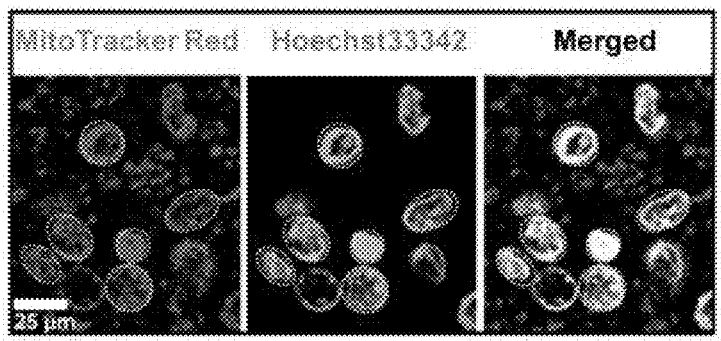
FIG. 28 shows MitoTracker Red-labeled mitochondria entered nuclei, and their colocalization is shown by confocal microscopy (n=5). Isolated mitochondria from platelets were co-cultured with purified nuclei of PB-IPC for 4 h in the presence of serum-free culture medium X-VIVO 15 at 37° C. and 5% $CO_2$.
Figure 29:
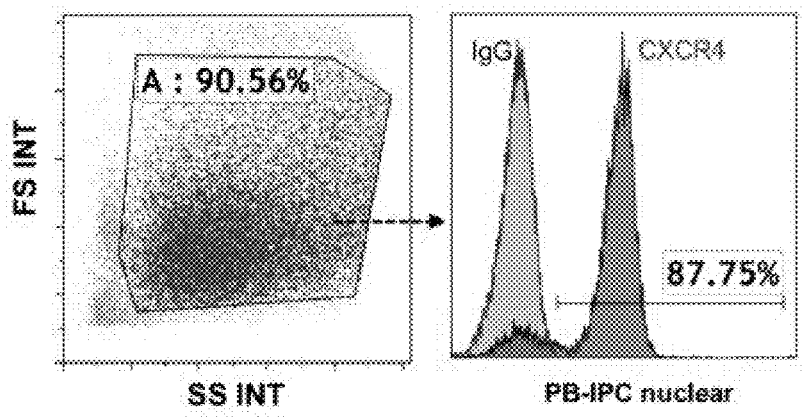
FIG. 29 shows expression of CXCR4 on the membrane of purified nuclei (n=4).

To explore the action of exogenous platelet-derived mitochondria in PB-IPC, mitochondria migrating to the nuclei of PB-IPC following treatment conditions was observed through electron microscopy, as shown in FIGS. 24-31. Mitochondria were observed crossing the nuclear membrane (FIG. 24), located inside nuclear matrices and close to the nucleolus (FIG. 25), and with a similar shape of mitochondrion in the cytoplasm (FIG. 25, indicated by arrow). Untreated PB-IPC failed to show such marked phenomena (FIG. 26). To further confirm the penetration of exogenous mitochondria into PB-IPC's nuclei, PB-IPC were treated with red fluorescent protein (RFP)-labeled mitochondria (FIG. 27), which were isolated from a HEK 293 cell line. After the treatment for 4 hours, confocal microscopy established RFP+ mitochondria infiltrating the cytoplasm (FIG. 27). To directly visualize the interaction between the mitochondria and the nucleus, freshly-purified PB-IPC-derived nuclei were treated with isolated MitoTracker Red-labeled mitochondria. Confocal imaging revealed direct interaction of mitochondria with nuclei, while some labeled mitochondria entered nuclei (FIG. 28). Based on the observation under transmission electronic microscope (TEM) and flow cytometry by staining with mitochondrial markers including MitoTracker Deep Red staining, anti-cytochrome C, and anti-heat shock protein (HSP) 60 mAbs, the frequency of intra-nuclear mitochondria was approximately 1-3%.

Figure 30:
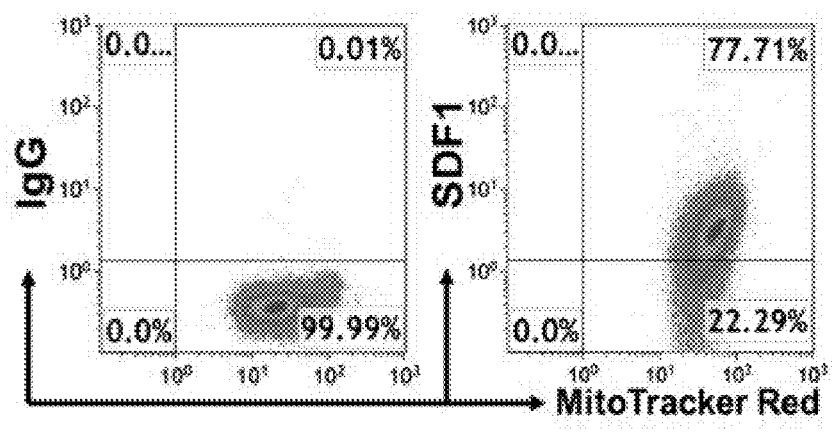
FIG. 30 shows mitochondria displaying CXCR4 ligand SDF-1 (n=4).
Figure 31:
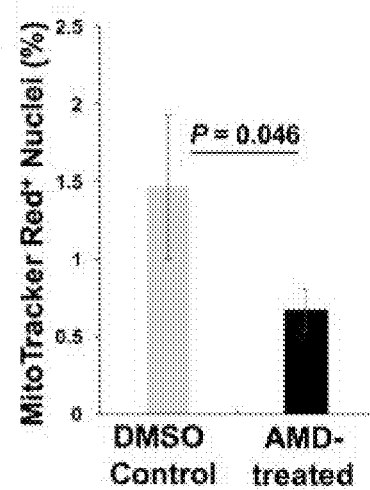
FIG. 31 illustrates a blocking experiment with CXCR4 receptor antagonist AMD 3100. Purified PB-IPC nuclei were treated with MitoTracker Red-labeled purified mitochondria in the presence or absence of AMD 3100 (30 µM, n=3). An equal concentration of solvent DMSO served as control. After the treatment for 4 hrs, nuclei were washed twice with PBS and prepared for flow cytometry.

Next, the molecular mechanisms underlying the migration of mitochondria to nuclei were explored. Flow cytometry demonstrated that nuclei displayed the chemokine receptor CXCR4 (the ligand for stromal cell-derived factor (SDF)-1) (FIG. 29), while mitochondria expressed SDF-1 (FIG. 30). To determine whether the action of SDF-1/CXCR4 contributed to the penetration of mitochondria into nuclei, a blocking experiment with CXCR4 receptor antagonist AMD3100 was performed. Purified PB-IPC nuclei were treated with MitoTracker Deep Red-labeled purified mitochondria in the presence or absence of AMD 3100. After the treatment for 4 hours, flow cytometry demonstrated that the percentage of MitoTracker Deep Red-positive nuclei was markedly reduced after the treatment with AMD 3100 (FIG. 31). This indicates that mitochondria entered into nuclei through the chemoattractant interactions between SDF-1 and CXCR4.

Figure 32:
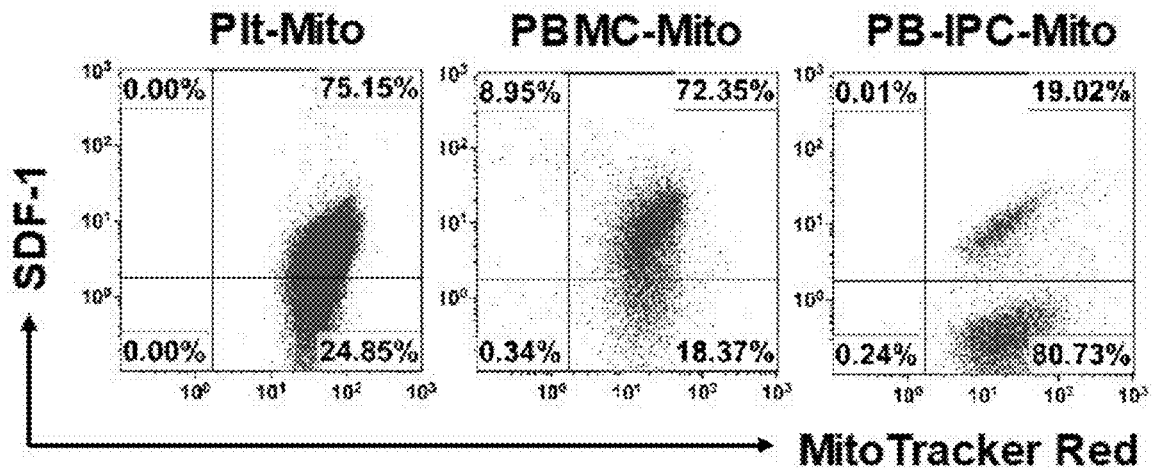
FIG. 32 shows flow cytometry illustrating the expression of SDF-1 on the platelet-derived mitochondria, PBMC-derived mitochondria, and PB-IPC-derived mitochondria. Isotype-matched IgGs served as controls. Data were representative from three experiments.
Figure 33:
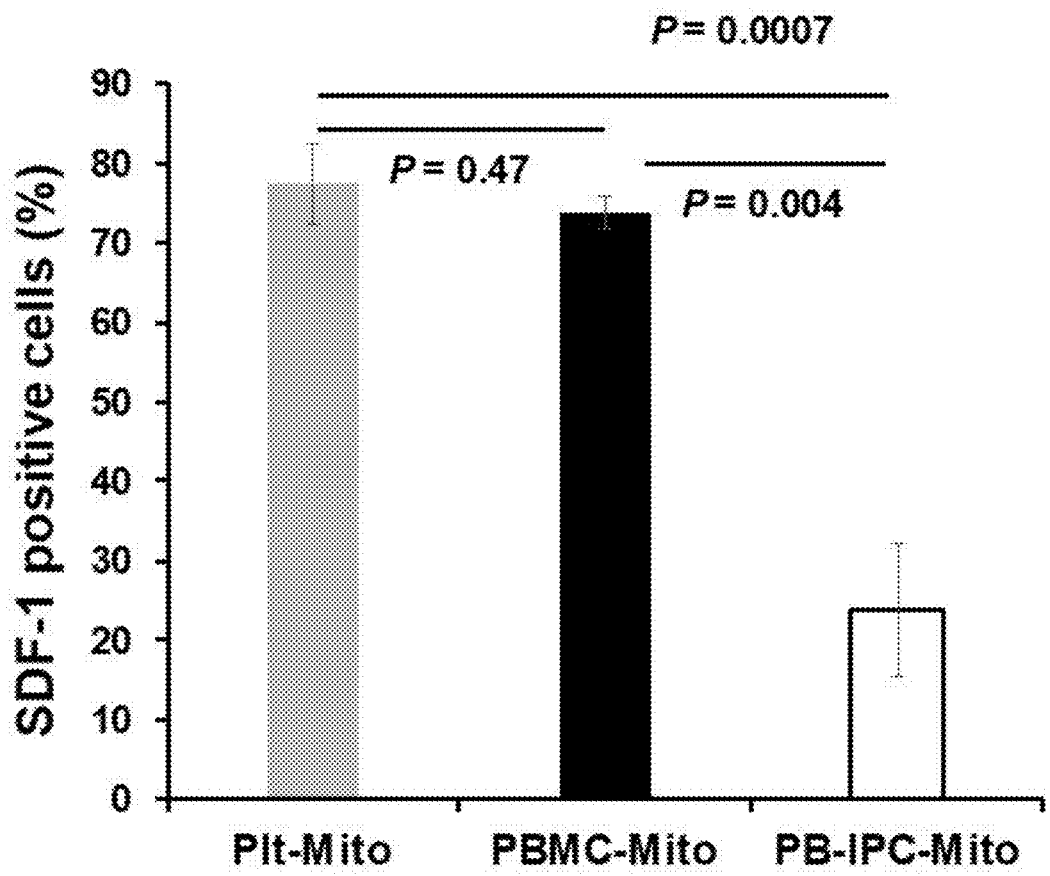
FIG. 33 shows a graphic comparison of the level of SDF-1 expression among platelet-derived mitochondria (Plt-Mito) and PBMC-derived mitochondria (PBMC-Mito) having no marked difference, but much lower SDF-1 expression among PB-IPC-derived mitochondria (PB-IPC-Mito). Data represent mean±SD, n=3.
Figure 34:
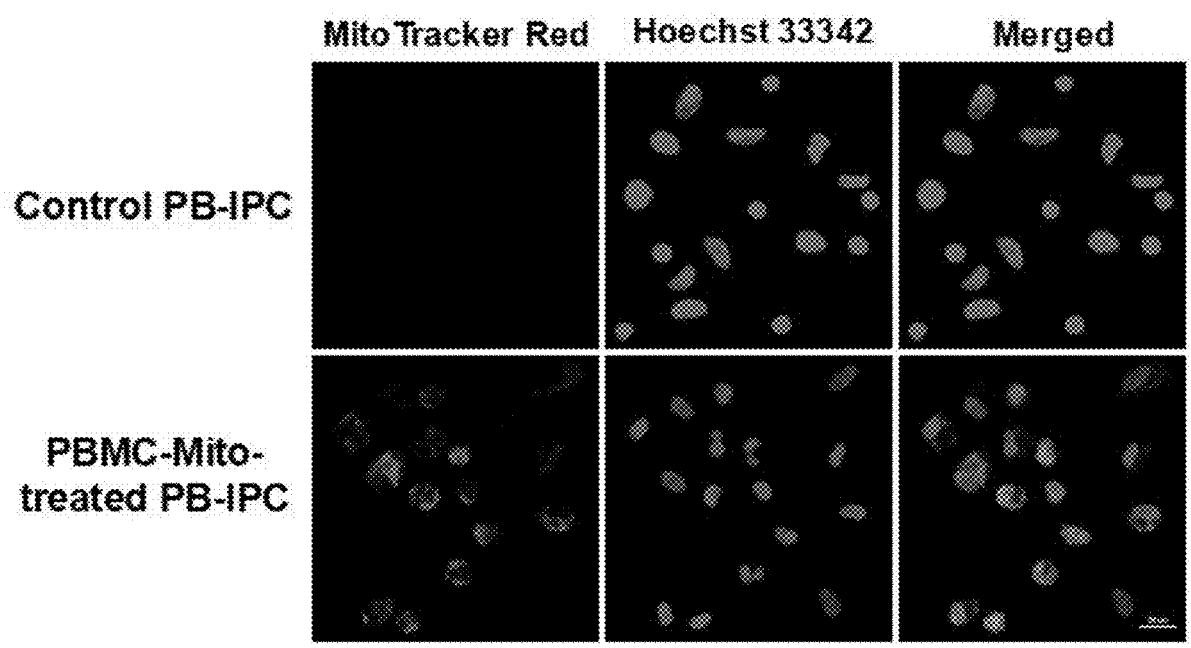
FIG. 34 is confocal microscopy imaging showing the penetration of PBMC-derived mitochondria into the nucleus of PB-IPC.

Additionally, it was observed that PBMC-derived mitochondria (not platelet-derived) could also penetrate the nucleus of PB-IPC with the incidence of 2.09±0.87%. FIGS. 32-34 show comparisons of SDF-1 expression among platelet-derived mitochondria, PBMC-derived mitochondria, and PB-IPC-derived mitochondria. Flow cytometry revealed that PBMC-derived mitochondria displayed a similar level of SDF-1 expression as that of platelet-derived mitochondria, but much higher than that of PB-IPC-derived mitochondria. PB-IPC were treated with MitoTracker Red-labeled PBMC-derived mitochondria (100 µg/ml) at 37° C. in 5% $CO_2$. After treatment for 4-6 hours, cells were observed and photographed with a Nikon AIR confocal microscope on an Nikon Eclipse Ti2 inverted base, using software NIS Elements Version 4.60. (FIGS. 32-34). Taken together with the results of blocking with CXCR4 receptor antagonist AMD 3100 on the purified nuclei of PB-IPC, these data indicate that the SDF-1/CXCR4 pathway contributes to the migration of mitochondria to the nuclear membrane of PB-IPC, leading to the penetration of the nucleus of PB-IPC.

Example 6

Genetic and Epigenetic Changes in PB-IPC after the Treatment with Mitochondria

Figure 35:
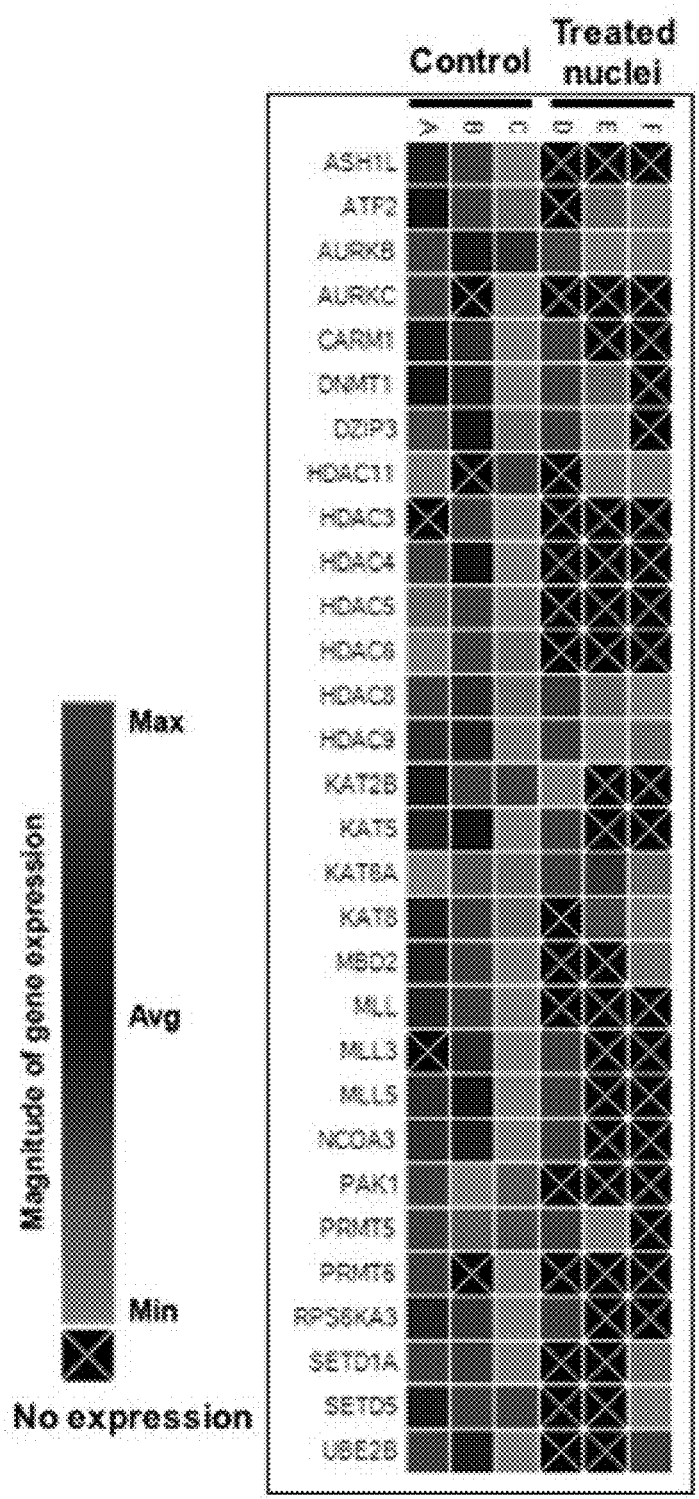
FIG. 35 shows a real time PCR array for epigenetic chromatin modification enzyme-related genes.

To investigate the mechanism by which mitochondria modulate expression in the nucleus, purified PB-IPC-derived viable nuclei were treated with isolated mitochondria for 4 hours at 37° C. and 5% $CO_2$, and changes in transcription were assessed by real-time PCR array. The data uncovered the marked changes in epigenetic chromatin modification enzyme-related genes including DNA methyltransferase 1 (DNMT1), histone acetyltransferases (activation transcription factor-2 (ATF2), lysine acetyltransferase 2B (KAT2B), KAT5, and KAT8), histone methyltransferases (coactivator-associated arginine methyltransferase 1 (CARM1), mixed lineage leukemia protein (MLL), MLL3, Protein arginine methyltransferase 5 (PRMT5), and PRMT6), histone methyltransferase activity-associated SET (Su (var), Enhancer of Zeste and Trithorax) domain proteins (ASHIL (absent, small, or homeotic)-like (*Drosophila*), SET domain containing 1A (SETDIA), and SETD5), histone phosphorylation ((aurora kinase B (AURKB), AURKC, p21 protein-activated kinase 1 (PAK1), and ribosomal protein S6 kinase polypeptide 3 (RPS6KA3)), Histone ubiquitination (DAZ interacting protein 3(DZIP3) and ubiquitin-conjugating enzyme E2B (UBE2B)), DNA and histone demethylase methyl-CpG binding domain protein 2 (MBD2), and histone deacetylases (histone deacetylase 3 (HDAC3), HDAC4, HDAC5, HDAC6, HDAC8, HDAC9, and HDAC11)) (FIG. 35).

Figure 36:
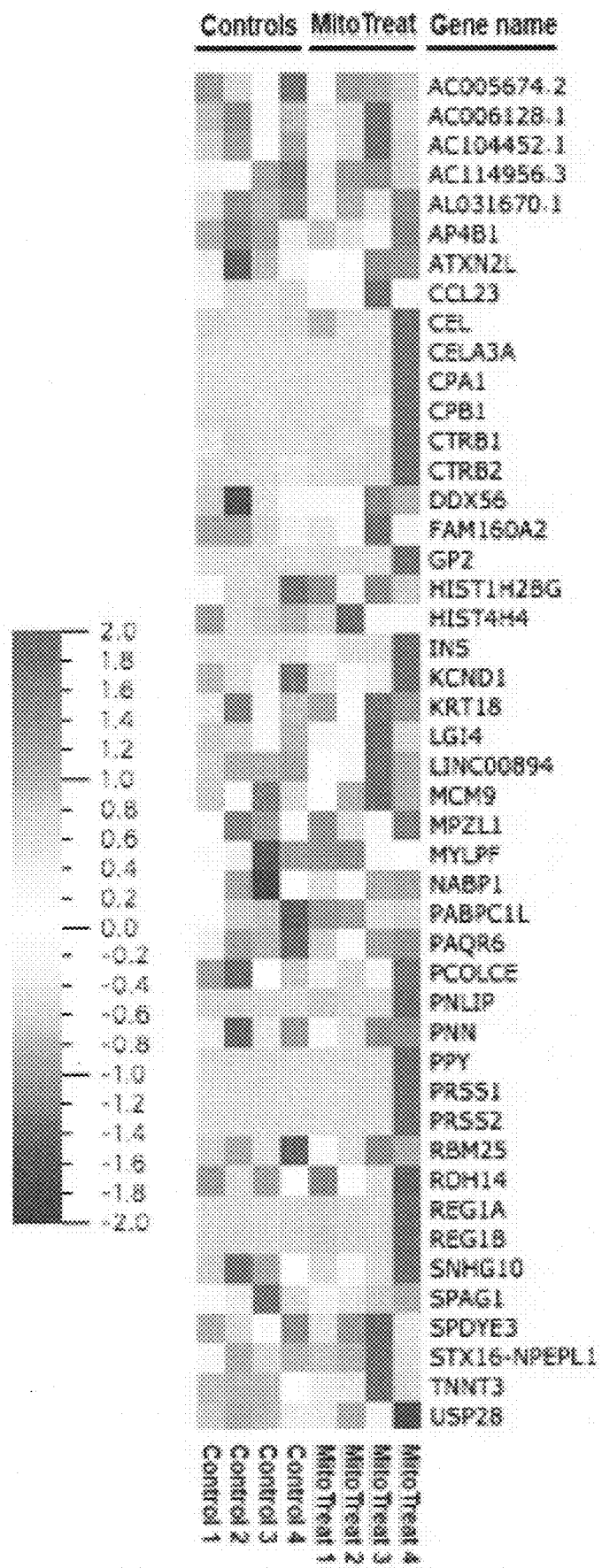
FIG. 36 shows an RNA-sequencing heatmap showing forty-six differentially expressed genes in PB-IPC after treatment with mitochondria.
Figure 37:
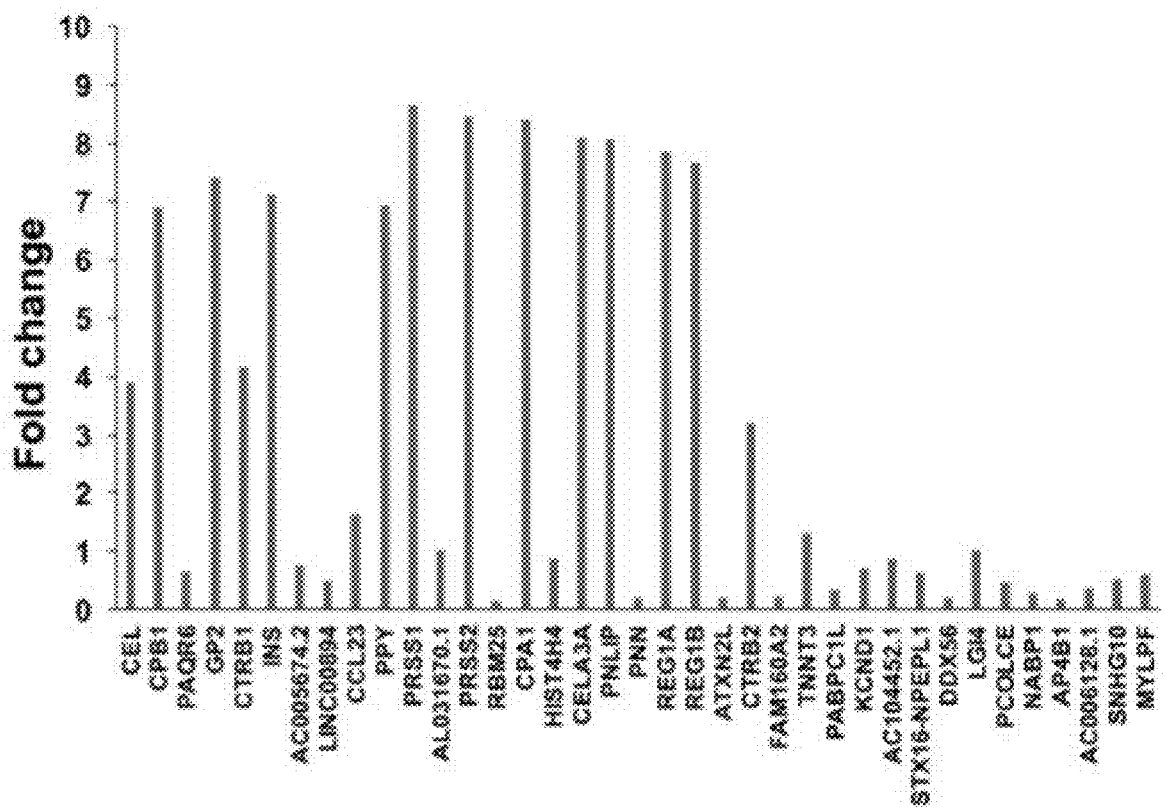
FIG. 37 shows RNA-sequencing data showing thirty-seven up-regulated genes in PB-IPC after treatment with mitochondria.
Figure 38:
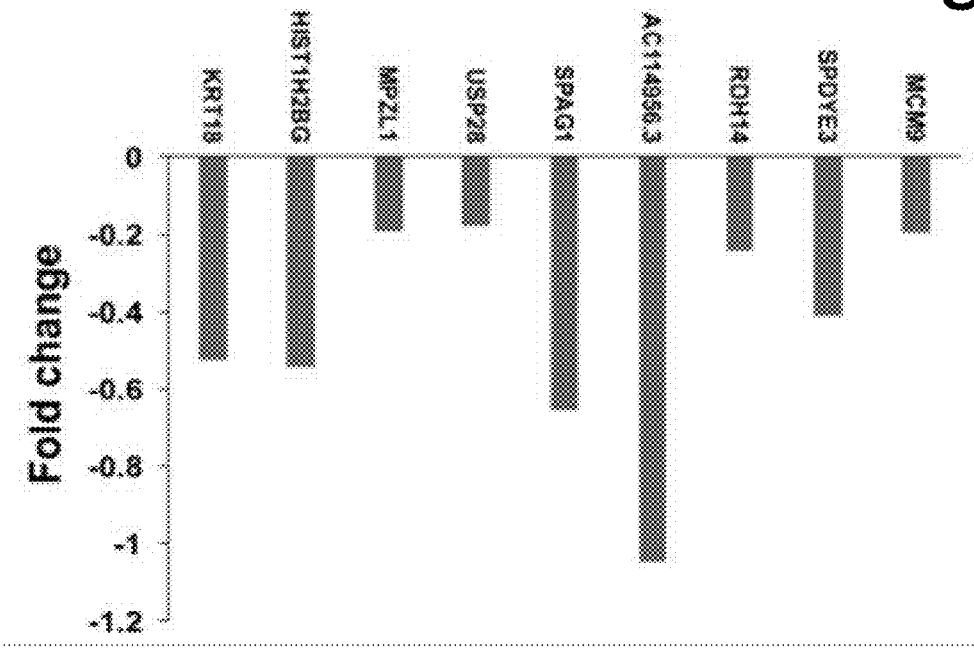
FIG. 38 shows RNA-sequencing data showing nine down-regulated genes in PB-IPC after treatment with mitochondria.

These data demonstrate that mitochondria that penetrate the nucleus contribute to both epigenetic and genetic regulations, leading to the reprogramming of PB-IPC. To find more differentially expressed genes, RNA sequencing (RNA-seq) analysis was performed between the mitochondrion-treated and untreated PB-IPC in four preparations (FIG. 36). The results demonstrated that 37 genes were markedly up-regulated in the mitochondrion-treated PB-IPC (FIG. 37, p<0.05), and 9 genes were down-regulated (FIG. 38, p<0.05). There were no significant changes for other genes (n=15,388, 99.7% of genes) in PB-IPC after the treatment with mitochondria.

Example 7

Figure 39:
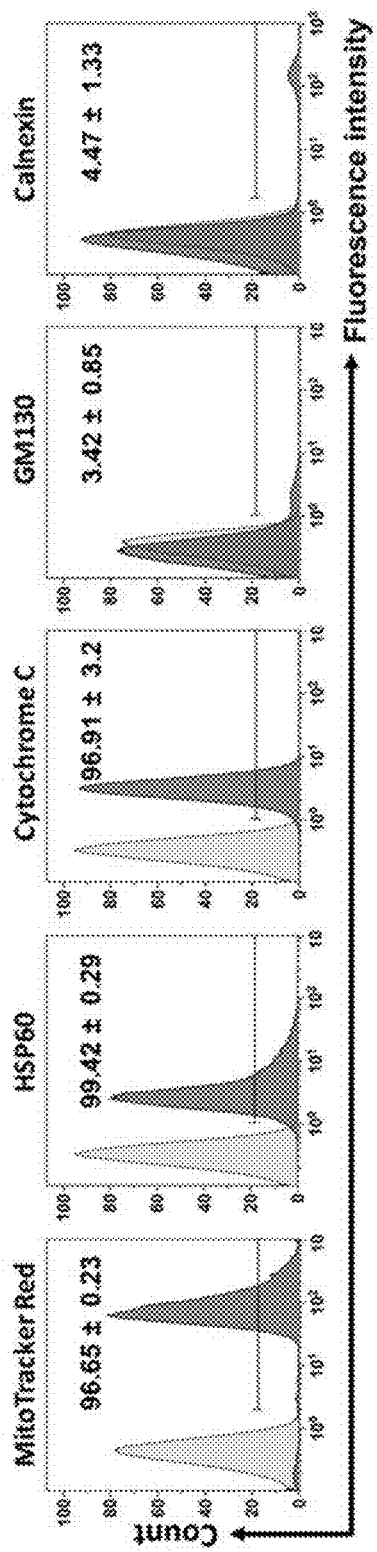
FIG. 39 shows purity analysis histograms for isolated mitochondria. Different markers were applied by flow cytometry, including MitoTrack Deep Red staining, anti-cytochrome C, and anti-heat shock protein (HSP). 60 Abs was used for mitochondrial markers, calnexin for endoplasmic reticulum (ER), and GM130 for Golgi apparatus. Isotype-matched IgGs served as negative controls (n=3).
Figure 40:
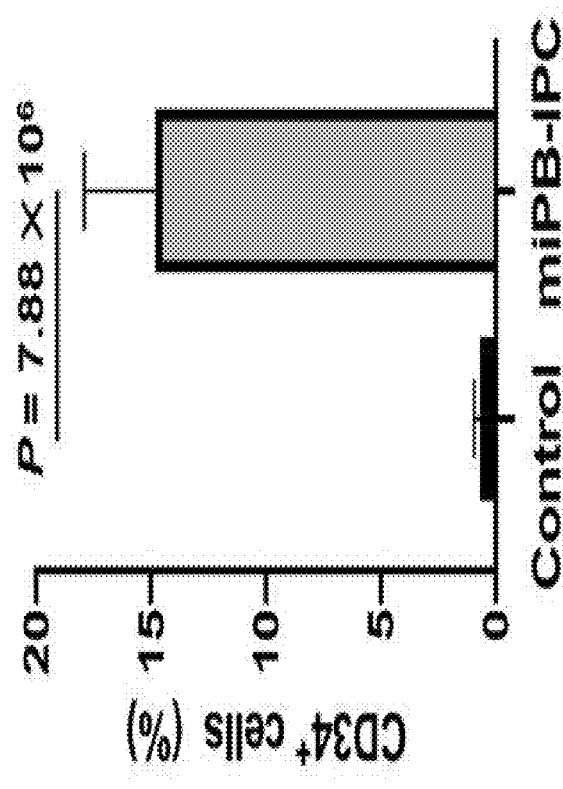
FIG. 40 shows CD34 expression upregulation after treatment with mitochondria in miPB-IPCs. Data represent mean±SD of five experiments.
Figure 41:
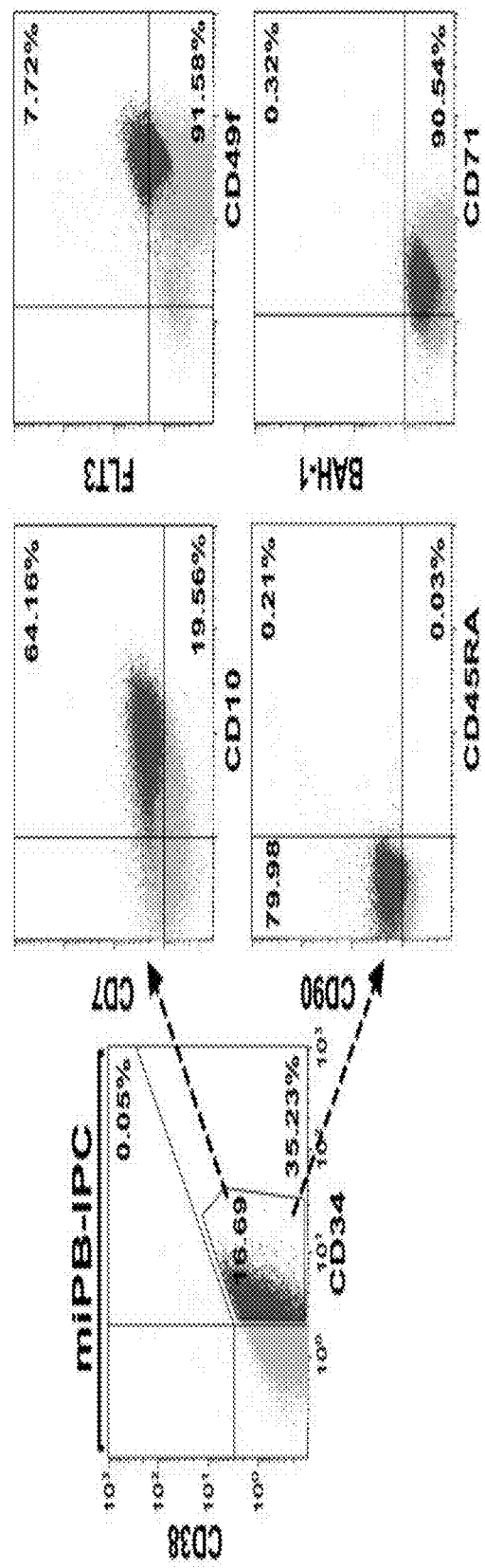
FIG. 41 shows phenotypic characterization of gated miCD34+ HSCs (dashed arrows) with additional surface markers in total miPB-IPCs. Isotype-matched IgGs served as controls. Data were representative from five preparations.
Figure 42:
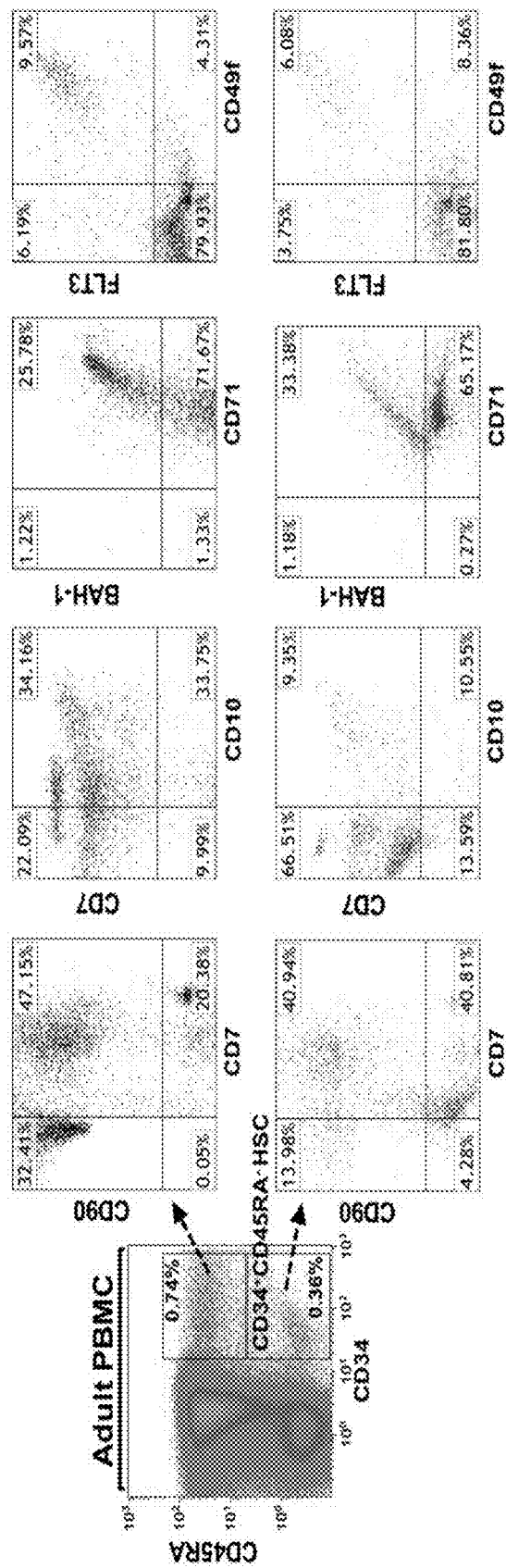
FIG. 42 shows phenotypic characterization of gated CD34$^+$CD45RA$^-$ HSCs with additional markers (bottom) and CD34$^+$CD45RA$^+$ cell population with additional markers (top) in total PBMCs (n=4). Isotype-matched IgGs served as controls. Data were representative from one of four preparations.

Ex Vivo Differentiation of Mitochondrion-Induced PB-IPCs (miPB-IPCs) into the Mitochondrion-Induced CD34$^+$-HSC-Like Cells (miCD34$^+$ HSCs) after Treatment with Platelet-Derived Mitochondria High-purity apheresis platelets (>99% CD41$^+$CD42$^+$ platelets) were obtained from the New York Blood Center for the following experimentation. FIGS. 39-42 illustrate the differentiation of PB-IPCs into CD34 HSC-like cells after treatment with platelet-derived mitochondria. To determine the purity of the mitochondria isolated from platelets, different markers were applied by flow cytometry including MitoTrack Deep Red staining, anti-cytochrome C and anti-heat shock protein (HSP) 60 Abs for mitochondrial markers, calnexin for endoplasmic reticulum (ER), and GM130 for Golgi apparatus. Flow cytometry demonstrated that 99% of isolated mitochondria were positive for MitoTrack Deep Red, HSP 60, and cytochrome C; there were about 5% cytochrome C$^+$ calnexin$^+$ cells and 4% cytochrome C$^+$GM130$^+$ (FIG. 39). The double-positive staining results may have been caused by the interaction and conjugation of mitochondria with the ER or Golgi apparatus, respectively. Flow cytometry analysis demonstrated that the purity of the isolated mitochondria was ≥90%. (FIG. 39). Purified platelet-derived mitochondria from autologous or allogeneic peripheral blood were prepared and treated to PB-IPCs that were isolated and expanded from blood samples of adult donors at the New York Blood Center (n=51; mean age of 48.76±14.97; age range from 18 to 72 years old; 24 males and 27 females). Notably, the expression of the HSC marker CD34 was upregulated in PB-IPCs after the treatment with mitochondria. A phenotypic analysis of miPB-IPCs after two weeks of mitochondrial treatment was striking in that the expression of CD34 on miPB-IPCs increased from 0.71%±0.25% to 14.8%±3.1% (p=7.88×10$^6$, n=5) (FIG. 40). Using an optimized panel of cell markers, it was observed that mitochondrion-induced CD34$^+$ (miCD34$^+$) cells displayed a phenotype of CD34$^+$CD38$^{-/low}$CD45RA$^-$CD49f$^+$CD90$^+$Flt3$^{-/low}$CD7$^+$CD10$^+$CD71$^+$BAH1$^{-/low}$ (14.8%±3.1%, n=5) (FIG. 41). In comparison to regular blood CD34$^+$CD45RA$^-$CD90$^+$Flt3$^{-/low}$CD7$^+$CD71$^+$ HSCs (0.49%±0.19%, n=4) from non-mobilized healthy donors, the miCD34$^+$ cells expressed similar surface markers as CD34$^+$CD45RA$^-$CD90$^+$Flt3$^{-/low}$CD7$^+$CD71$^+$ (15.3%±2.9%, n=5, p<0.01), but higher levels of CD10 (a marker defining human lymphoid progenitors) (99.4%±0.36% versus 20.6%±3.1%, p<0.01), CD49f (a common biomarker for most populations of stem cells) (98.8%±1.3% versus 15.4%±2.9%, p<0.01), and lower level of BAH-1 (a marker for human megakaryocyte-erythroid progenitor) (0.51%±0.2% versus 32.5%±3.9%, p<0.01) (FIGS. 41-42). Due to co-expressions of CD7 and CD10 (the surface markers for common lymphoid progenitor (CLP) cells) on miCD34$^+$ HSCs, the data suggested that miCD34$^+$ HSCs have a high potential to give rise to lymphocytes.

Example 8

Differentiation of miCD34$^+$ HSCs into T Cells

Figure 44:
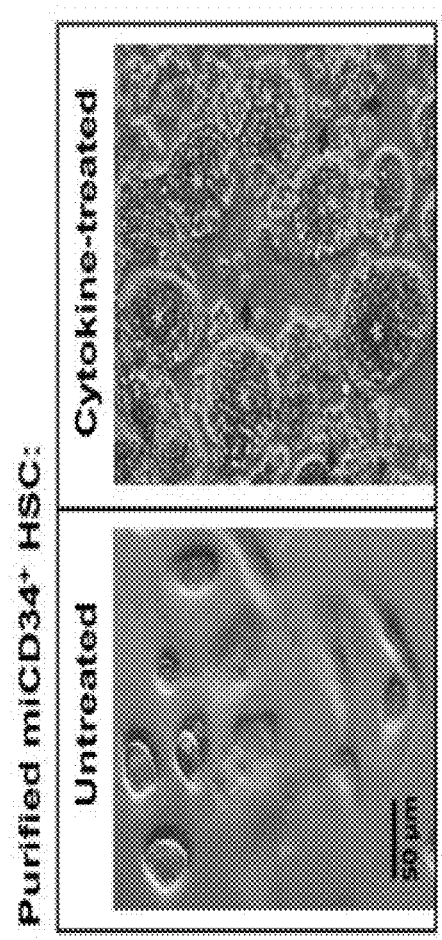
FIG. 44 is phase-contrast imaging showing T-cell differentiation of purified miCD34$^+$ HSCs in the presence of FLT-3 ligand, IL-2, and IL-7 for 3 days (n=4). Untreated cells served as a control (left). The treated-CD34$^+$ HSCs displayed substantial morphological changes with cell clusters (stars), and some floating cells (arrows) released from cell clusters (stars). Magnification: ×200.
Figure 46:
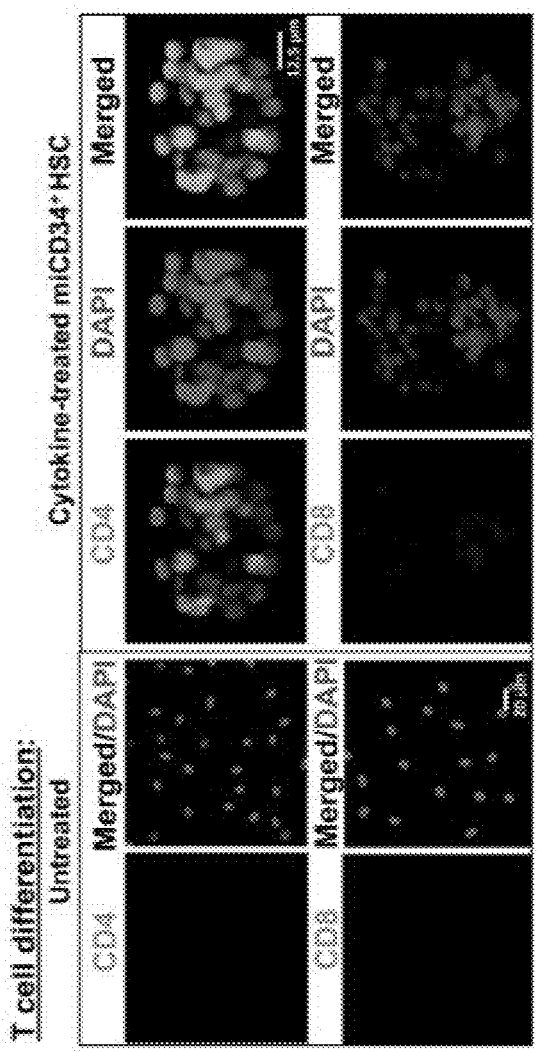
FIG. 46 shows z-stacked confocal images demonstrating strong expression of human T-cell marker CD4 with a low expression of CD8 (n=4). Untreated miCD34$^+$ HSCs served as control for immunostaining (left panel).
Figure 45:
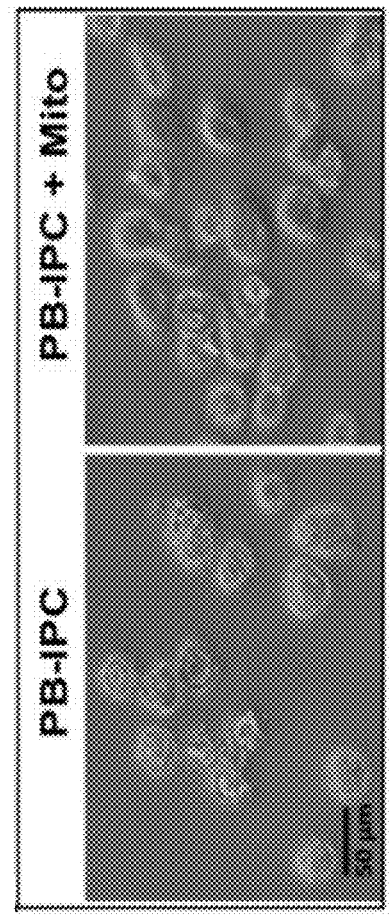
FIG. 45 is phase-contrast imaging showing the morphology of control PB-IPCs (left) and treated PB-IPCs in the presence of mitochondria (right) (n=4). Original magnification: ×200.
Figure 47:
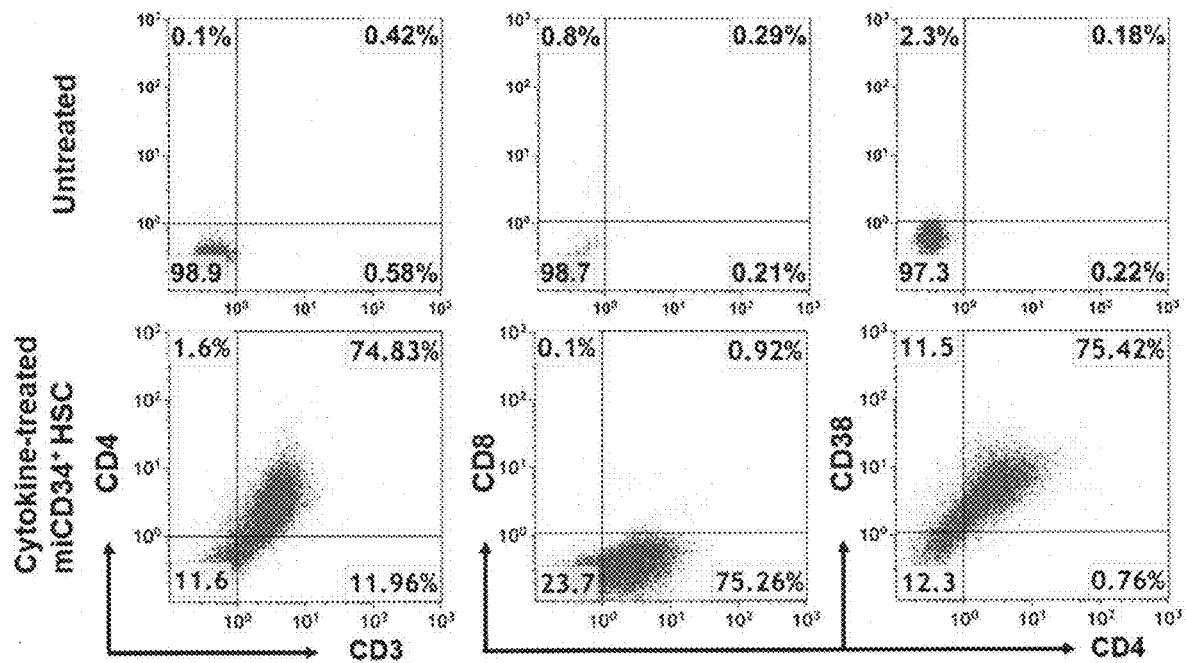
FIG. 47 shows flow cytometry illustrating that differentiated T cells were CD3$^+$CD4$^+$CD8$^-$CD38$^+$ (n=4). Untreated miCD34$^+$ HSCs served as controls (top panel).
Figure 48:
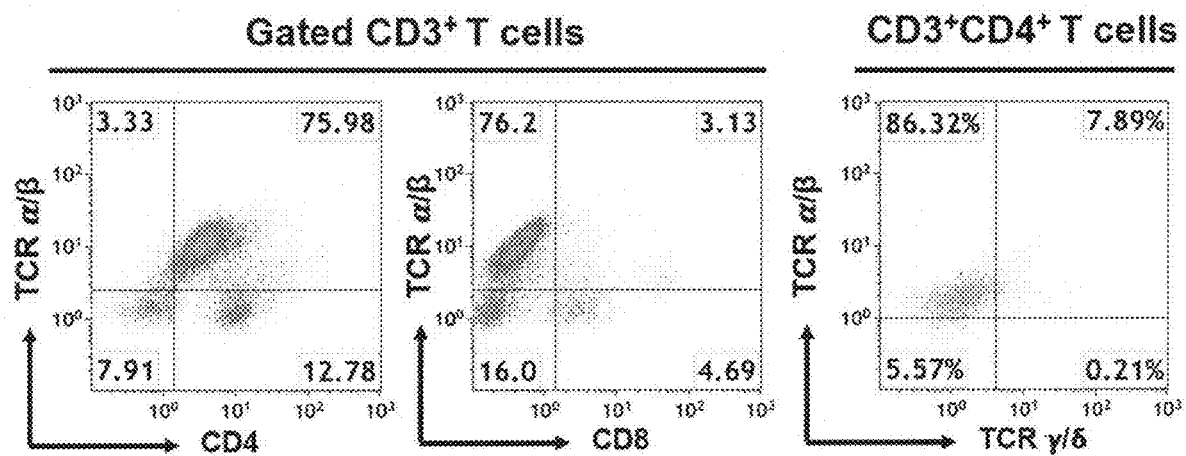
FIG. 48 illustrates expression of T-cell receptors α/β (TCRαβ) in gated CD3$^+$ and CD4$^+$ T cells (n=4).
Figure 49:
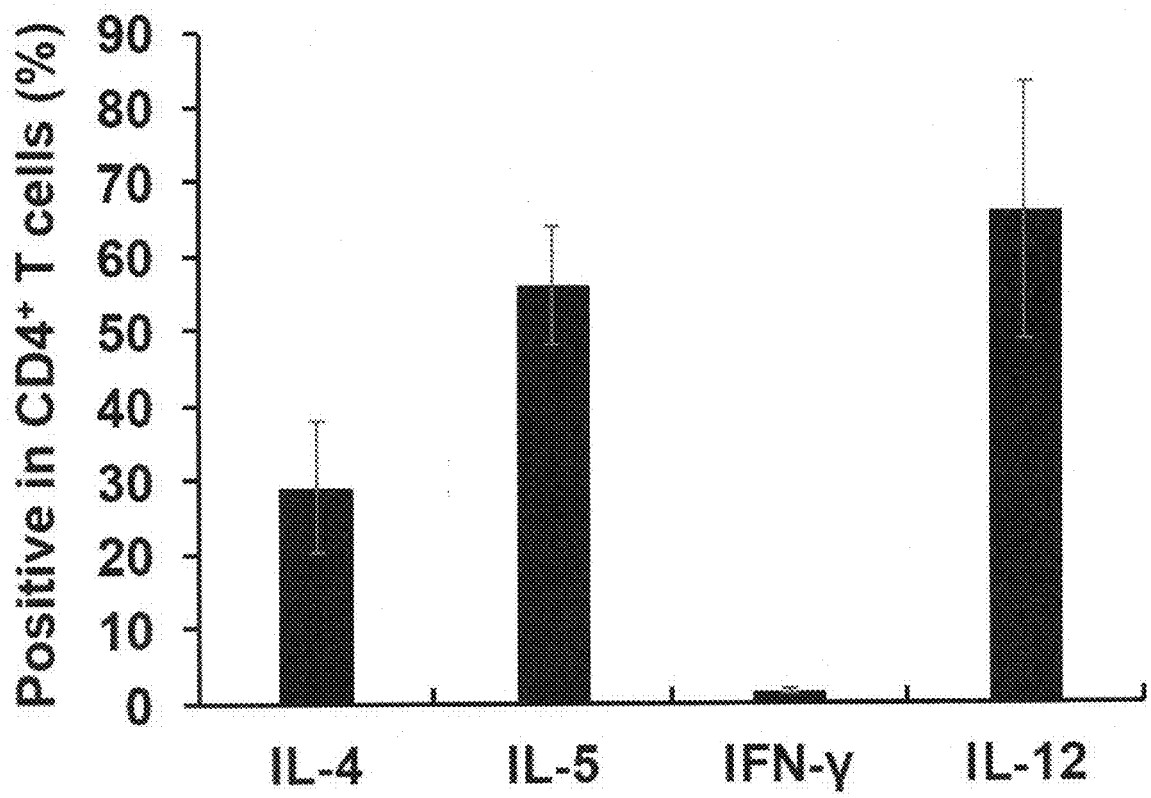
FIG. 49 shows intracellular staining of differentiated T cells with Th1/Th2 cell cytokine markers (n=3). Isotype-matched IgG served as a control. Data are presented as mean±SD from three experiments.
Figure 50:
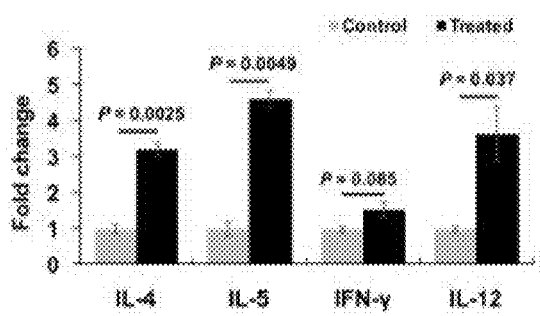
FIG. 50 shows fold-changes of cytokine expression levels in in vitro differentiated T cells after the stimulation with PMA and ionomycin (n=3). Data represent mean±SD

FIGS. 43-50 illustrate in vitro differentiation of purified miCD34$^+$ HSCs to T cells. To determine whether miCD34$^+$ cells were functional as stem cells, they were purified from miPB-IPCs and treated with different inducers (FIG. 43). First, the potential to differentiate into T cells was examined by treating purified miCD34$^+$ cells with recombinant FMS-like tyrosine kinase (FLT)-3 ligand, interleukin (IL)-2, and IL-7 for 3 days. Phase-contrast microscopy revealed marked morphological changes, and the differentiated T cells had numbers of cell clusters in this cytokine-treated group, with some cells released into the supernatant (FIG. 44, right). Cells in the control groups exhibited a smooth surface and failed to show any morphological changes (FIG. 44, left, and FIG. 45). Confocal microscopy demonstrated that the differentiated cells strongly expressed human T cell marker CD4, with weak expression of CD8 (FIG. 46). Flow cytometry further confirmed the differentiation of miCD34$^+$ HSCs into CD3$^+$CD4$^+$CD8$^-$CD38$^+$ T cells at a percentage of 76.93%±3.21% (FIG. 47, n=4), which were CD3$^+$CD4$^+$ TCRαβ$^+$ T cells (82.65%±5.2%, n=3) (FIG. 48). Intracellular staining with T-cell functional markers indicated that these T cells produced Th1 cytokine IL-12 (65.3%±20.1%, n=3) and Th2 cytokines IL-4 (28.5%±9.99%, n=3) and IL-5 (53.9%±11.2%, n=3), with a very low level of interferon (IFN)-γ (0.61%±0.3%, n=3) (FIG. 49). Additional functional tests established the significantly upregulated expression levels of cytokines such as IL-4 (p=0.0025, n=3), IL-5 (p=0.0049, n=3), and IL-12 (p=0.037, n=3) after the treatment with phorbol 12-myristate 13-acetate (PMA) and ionomycin. The level of INF-γ failed to show a marked change (p=0.085, n=3). The data confirmed that the differentiated T cells responded to the stimulation of PMA/ionomycin (FIG. 50). The rapid differentiation of T cells with high efficiency clearly demonstrated that miCD34$^+$ HSCs were converted into functional and definitive hematopoietic progenitors.

Example 9

Ex Vivo Differentiation of miCD34$^+$ HSCs into Other Hematopoietic Lineages

Figure 51:
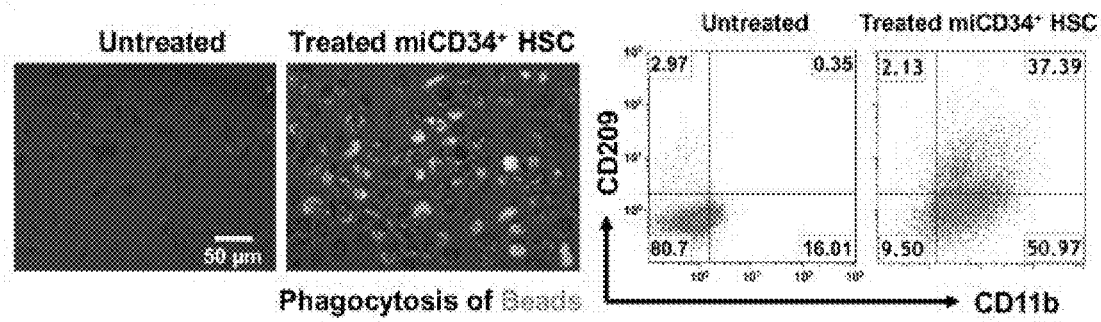
FIG. 51 illustrates differentiation of miCD34$^+$ HSCs into macrophages after treatment with 50 ng/ml M-CSF for 3 days. Differentiated Mφ displayed macrophage markers CD11b and CD209, and exhibited phagocytosis of florescence beads (n=4). Untreated miCD34$^+$ HSCs served as controls.

FIGS. 51-57 show ex vivo multiple differentiations of miCD34$^+$ HSCs. To further examine their potential for differentiation, miCD34$^+$ HSCs were treated with macrophage colony-stimulating factor (M-CSF) for 3 days, whereupon they became adherent, well-spaced cells. Functional analysis established that M-CSF-treated miCD34$^+$ HSCs exhibited strong phagocytosis of fluorescent latex beads (FIG. 51, middle), while untreated cells were mostly negative for this effect (FIG. 51, left). Flow cytometry confirmed that 34.3%±4.3% of the cells were CD11b$^+$CD209$^+$ macrophages (MP), and about 53.66%±3.8% were CD11b$^+$CD209$^-$ macrophages (MΦ) (FIG. 51, right). In contrast, there were only 15.29%±1.5% CD11b$^+$CD209$^-$ macrophages and 0.43%±0.12% CD11b$^+$CD209$^+$ macrophages in untreated miCD34$^+$ HSCs.

Figure 52:
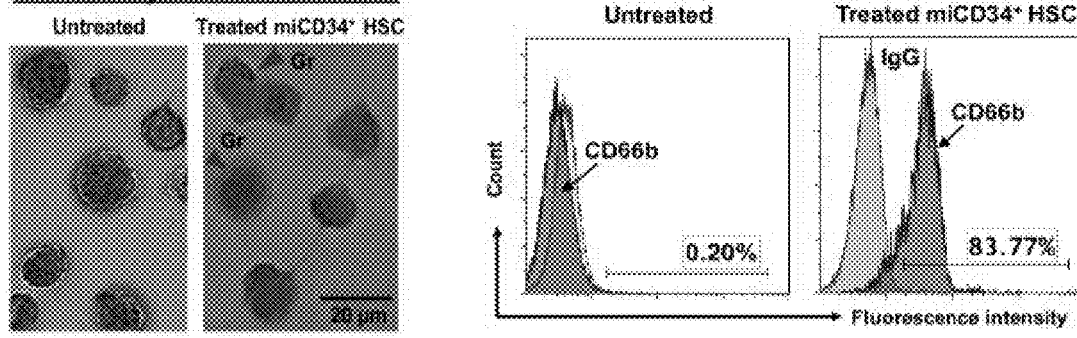
FIG. 52 illustrates differentiation of miCD34$^+$ HSCs into granulocytes after treatment with 100 ng/mL G-CSF+25 ng/mL FLT-3L for 3 days, followed by Wright-Giemsa staining (left), and flow cytometry for granulocyte marker CD66b (n=4). Untreated miCD34$^+$ HSCs served as controls.
Figure 53:
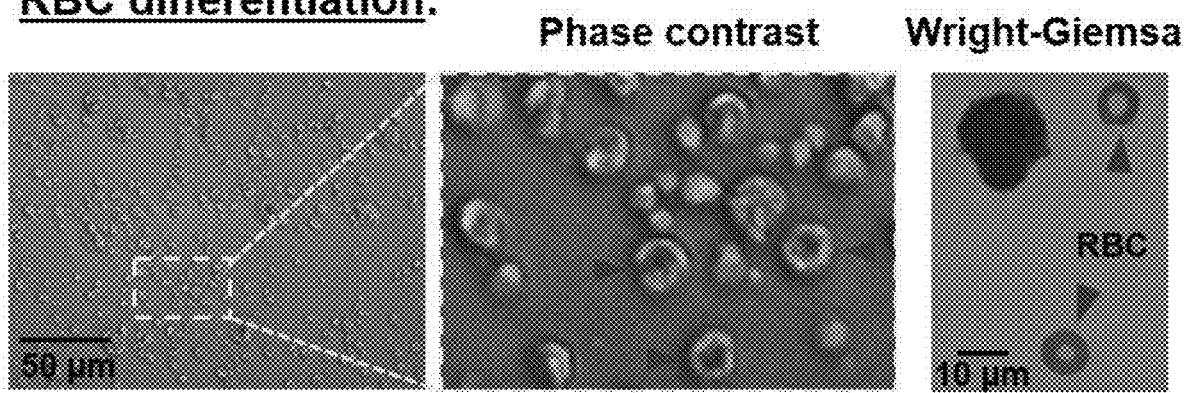
FIG. 53 illustrates differentiation of miCD34$^+$ HSCs into erythrocytes shown by phase-contrast imaging of mature RBCs (indicated by arrows), and by Wright-Giemsa staining with typical morphology of mature RBCs (indicated by arrows) (n=4).
Figure 54:
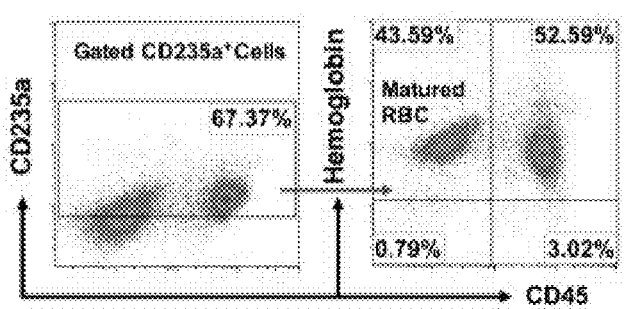
FIG. 54 shows analysis of the percentage of the matured CD45$^-$hemoglobin$^+$ RBCs in the gated CD235a$^+$ cells by flow cytometry (n=4).
Figure 55:
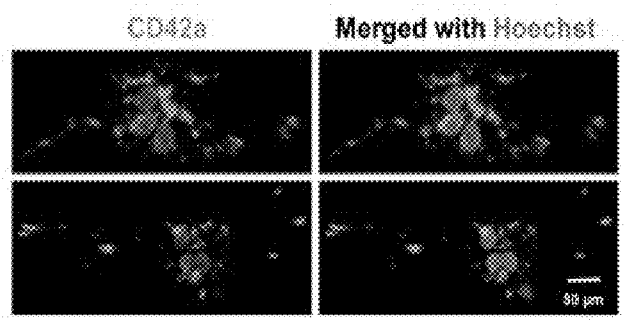
FIG. 55 illustrates differentiation of miCD34$^+$ HSCs into megakaryocytes (MKs)/platelets after the treatment with FLT-3L+TPO for 7 days, exhibiting CD42$^+$ and a polynuclear appearance (n=4).
Figure 56:
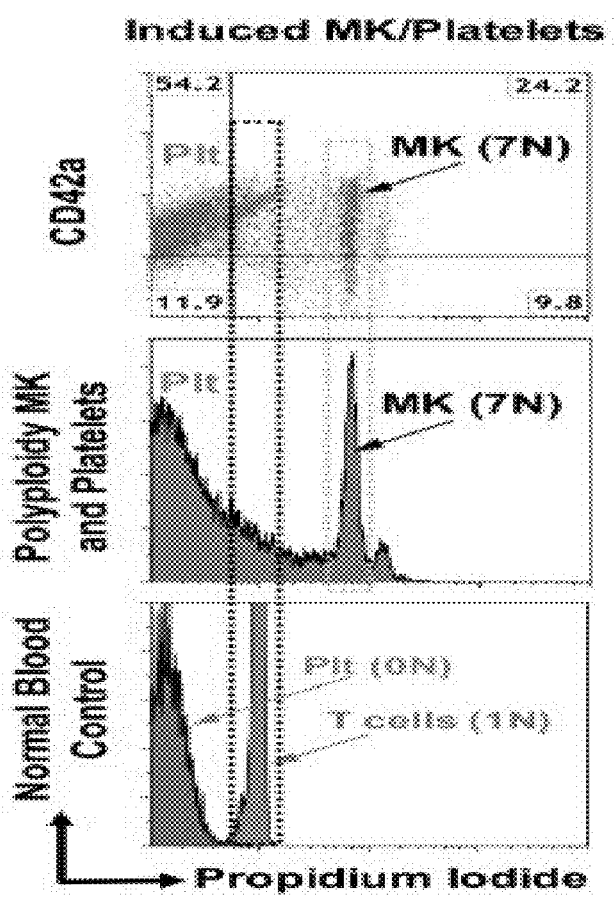
FIG. 56 shows analysis of polyploid MKs post-treatment with FLT-3L+TPO for 7 days, shown by histogram (middle) and dot plot with MK/platelet marker CD42a (top). Normal platelets and T cells from healthy donors served as controls for cells with no nucleus (ON) and one nucleus (1N), respectively (bottom) (n=4).
Figure 57:
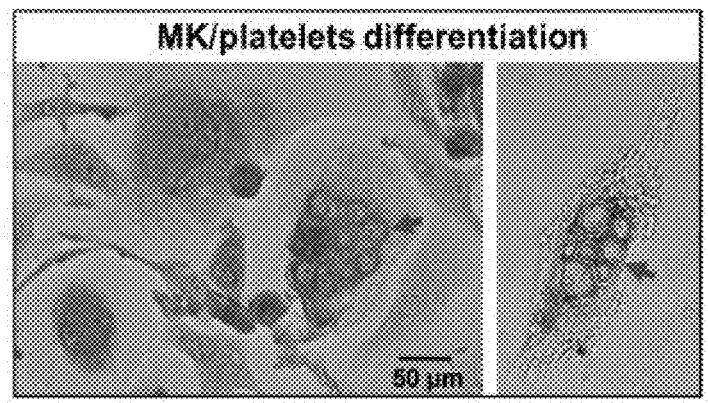
FIG. 57 shows Wright-Giemsa staining illustrating differentiated miCD34$^+$ HSCs with multiple nuclei (indicated by arrows) after treatment with FLT-3L+TPO for 7 days (n=4).

Next, miCD34$^+$ HSCs were induced to granulocyte colony-stimulating factor (G-CSF). After 3 days, 81.14%±3.7% of treated cells displayed the granulocyte-specific marker CD66b, with a reduced nuclear-cytoplasmic ratio and multi-lobed nuclei shown by Wright-Giemsa staining (FIG. 52). However, the untreated miCD34$^+$ HSCs failed to express CD66b and displayed large nuclei, with a large nuclear-cytoplasmic ratio (FIG. 52, n=4). Moreover, after being treated with erythropoietin (EPO) for 5 days, miCD34$^+$ HSCs turned into nucleated cells strongly positive for the erythroid (Er) lineage marker CD235a and facilitated RBC maturation via expulsion of their nuclei with additional EPO treatment, exhibiting a distinctive biconcave shape and enucleated RBCs (FIG. 53). In total, 41.4%±11.46% of cells were terminally differentiated into enucleated CD235a$^+$ CD45$^-$hemoglobin$^+$ RBCs (FIG. 54, n=4). However, untreated cells failed to show these differentiations, or only expressed background levels of these markers. Further flow cytometry analysis demonstrated that the level of hemoglobin expression was increased in the matured RBCs, with the mean fluorescence intensity of hemoglobin$^+$CD45$^-$ mature RBCs at 13.61±4.29, while hemoglobin$^+$CD45$^+$ immature RBCs was 8.29±1.61 (p=0.044, n=4).

Additionally, the commitment of miCD34$^+$ HSCs to MKs and platelets, which are critical for blood clotting, was examined. After treatment with FLT-3 ligand and thrombopoietin (TPO) for 7 days, production of CD42$^+$ MKs was achieved with typical polyploidization (mostly from 2N to 7N) (FIGS. 55-57) and the formation of non-nucleated CD42$^+$ platelets (21.3%±4.1%, n=4) (FIGS. 55-56), yielding 95±17 platelets per MK. Approximately 54% of mature CD42$^+$ platelets were released into the supernatant (FIG. 3F, n=4).

Example 10

In Vivo Differentiation of miCD34$^+$ HSCs into Other Hematopoietic Lineages after Transplant into NSG Mice To further determine multipotent features, purified miCD34$^+$ HSCs were transplanted into irradiated nonobese diabetic (NOD)/Lt-scid/IL2Rγ$^{null}$ (NSG) mice (FIG. 2). FIGS. 58-63 show multiple in vivo differentiations of miCD34$^+$ HSCs after transplantation into the irradiated NSG mice. The chimerism of human CD45$^+$ cells in peripheral blood, spleen, and bone marrow of miCD34 HSC-engrafted mice was examined at 12 weeks, by using flow cytometry analysis with blood cell lineage-specific markers including T cells (CD3$^+$CD4$^+$), B cells (CD19$^+$), monocytes (CD14$^+$), granulocytes (CD66b$^+$), erythroid cells (CD235a$^+$), and megakaryocytes/platelets (CD41b$^+$). To determine the multilineage differentiations of miCD34$^+$ HSCs after transplantation into irradiated NSG mice, only the viable cells from different samples were gated for analysis after excluding propidium iodide (PI)-positive dead cells. The gated human leukocyte common antigen CD45-positive and mouse CD45.1-negative viable cells were analyzed for characterization with different lineage-specific surface markers such as CD3 and CD4 for T cells; CD19 for B cells; CD41b for megakaryocytes/platelets; CD14, CD11b, and CD11c for monocytes/macrophages; CD66b for granulocytes; and CD235a for erythroid cells. SYTO60 was utilized to stain the CD235a$^+$ nucleated erythroid cells. Isotype-matched IgGs served as controls for flow cytometry.

Figure 58:
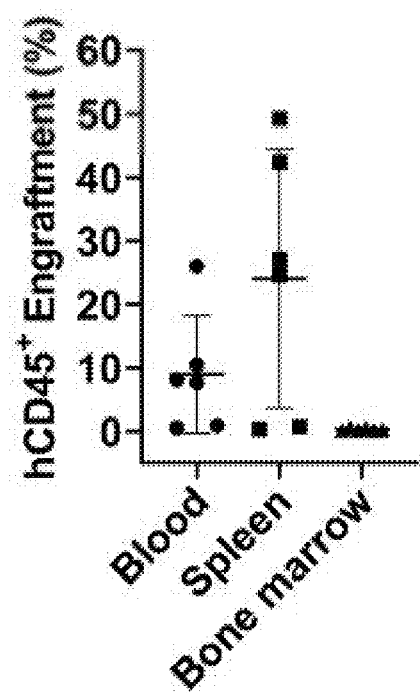
FIG. 58 displays engraftment levels of hCD45$^+$mCD45.1$^-$ cells in peripheral blood, spleen, and bone marrow of miCD34$^+$ HSC-transplanted NSG mice at 12 weeks (3×10$^5$ cells/mouse in 200 µL physiological saline, i.v., n=6).
Figure 59:
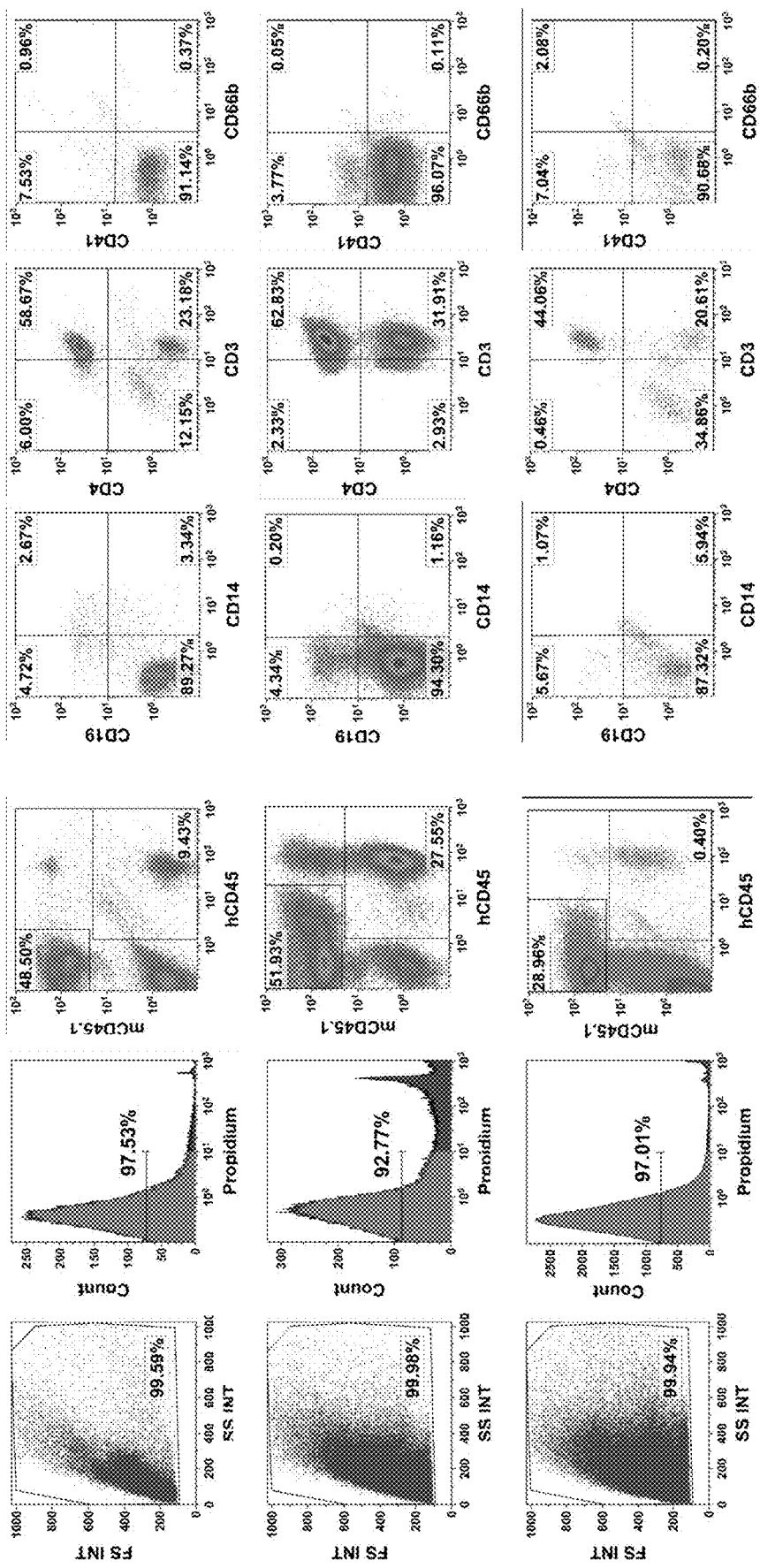
FIG. 59 shows phenotypic characterization of miCD34$^+$ HSCs post engraftment into the irradiated NSG mice (3×10$^5$ cells/mouse in 200 µL physiological saline, i.v., n=5). Tissue samples were collected 12 weeks after the transplantation. Only the viable cells (histogram) were gated for analysis after excluding propidium iodide (PI)-positive dead cells. Gated human leukocyte common antigen CD45-positive and mouse CD45.1-negative viable cells were analyzed. Representative data are from one of three experiments with similar results. Isotype-matched IgGs served as controls for flow cytometry.
Figure 60:
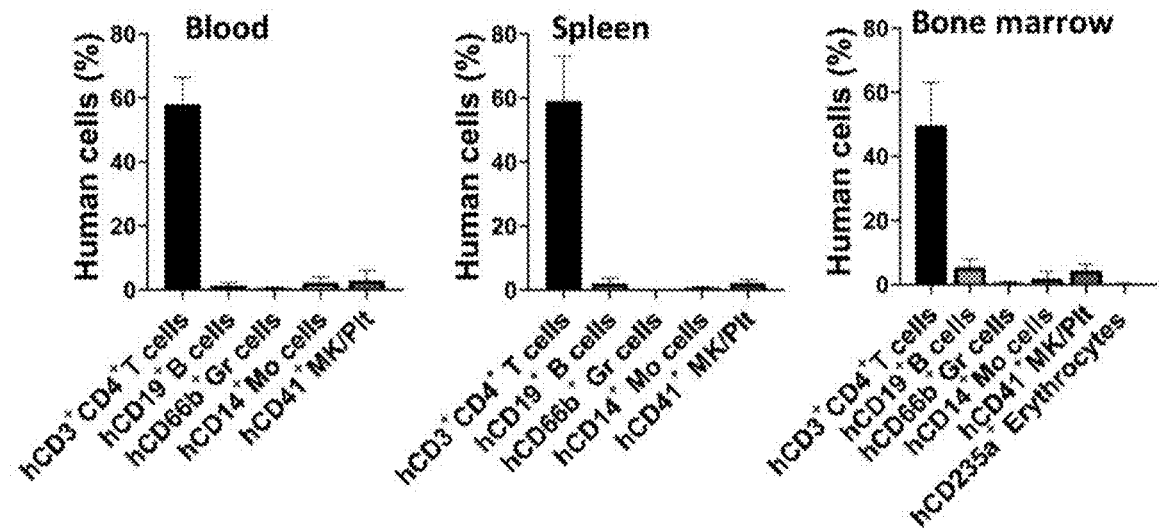
FIG. 60 shows multi-lineage differentiations of miCD34$^+$ HSCs at 12 weeks after transplantation into irradiated NSG mice.
Figure 61:
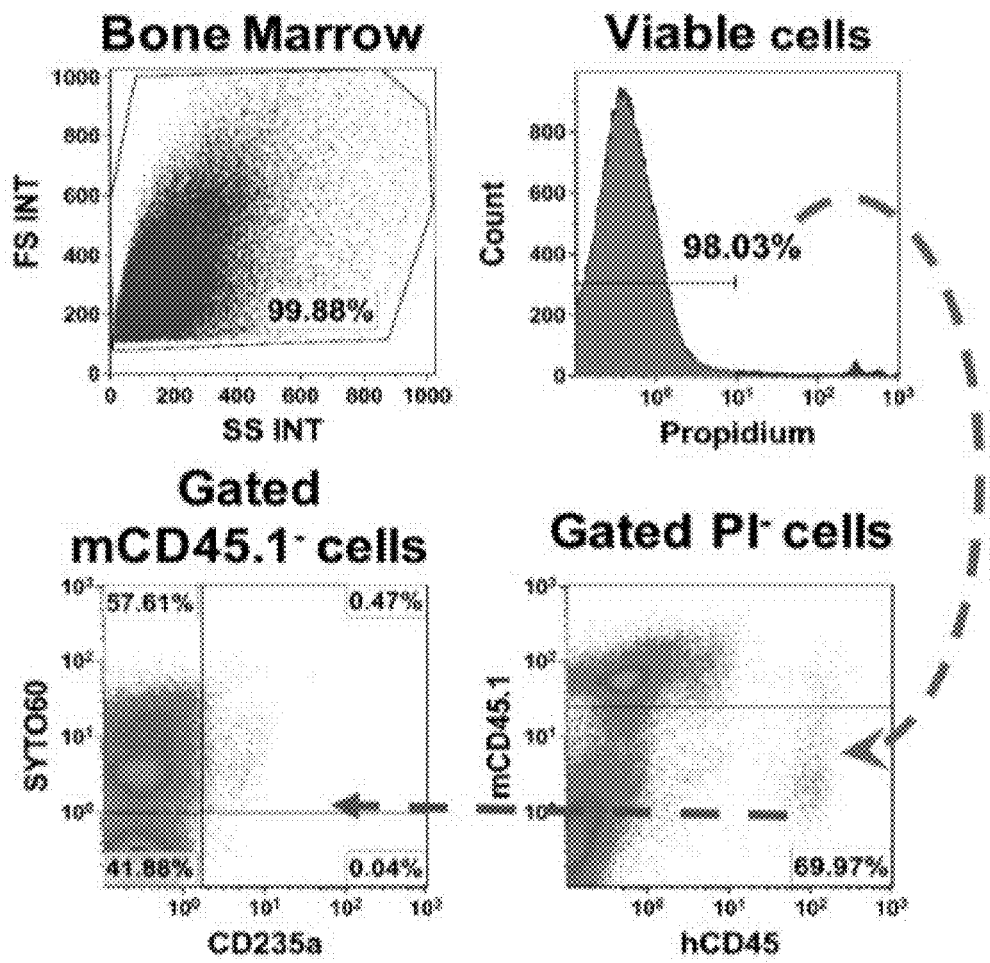
FIG. 61 shows erythroid reconstitution of miCD34$^+$-transplanted NSG mice at 12 weeks (n=6). Only viable cells (histogram) were gated for analysis after excluding propidium iodide (PI)-positive dead cells. SYTO60 was utilized to stain the CD235a$^+$ nucleated erythroid cells.
Figure 62:
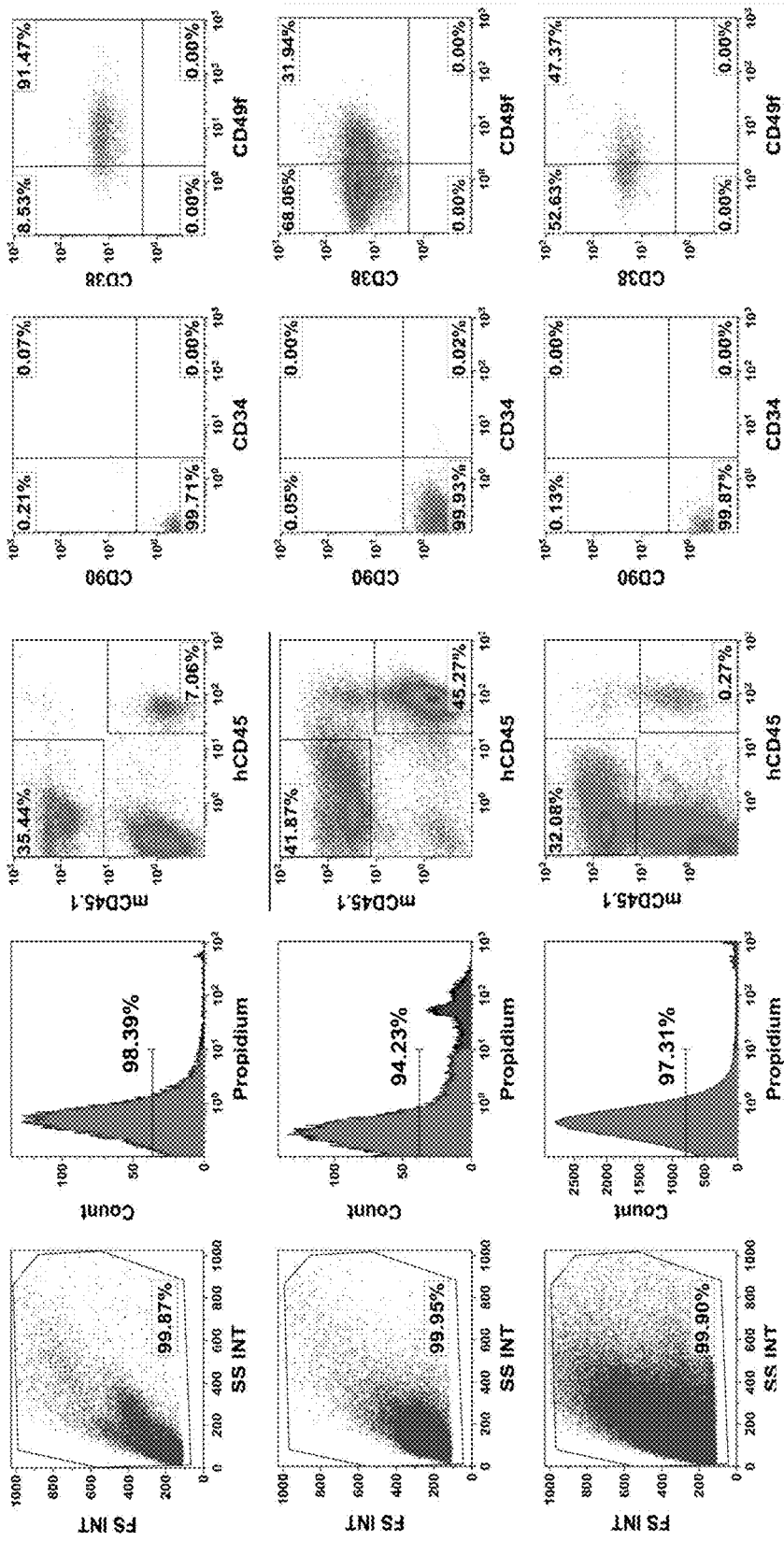
FIG. 62 illustrates characterization of miCD34$^+$ HSCs 12 weeks after engraftment in irradiated NSG mice (n=5). Representative data are from one of three experiments with similar results. Gated human CD45-positive and mouse CD45.1-negative viable cells were analyzed. Isotype-matched IgGs served as controls for flow cytometry.

The engraftment levels of human CD45$^+$ cells in blood (9.93%±9.62%, p=0.035) and spleen (25.37%±21.89%, p=0.018) were much higher than that in bone marrow (0.33%±0.15%) at 12 weeks post-transplantation (FIG. 58, n=6 mice). The miCD34$^+$ HSC-derived CD3$^+$CD4$^+$ T cells remained a predominant population at 57.92%±8.49% of human CD45$^+$ blood cells at 12 weeks after transplantation, with different proportions of other engrafted cells in the blood. Similar data (59%±13.55% of CD3$^+$CD4$^+$ T cells) were obtained from splenocytes of miCD34$^+$ HSC-engrafted mice (FIGS. 59-60, n=5 mice). By comparison, the percentage of miCD34$^+$ HSC-derived CD3$^+$CD4$^+$ T cells in bone marrow was 49.45%±14.01% at 12 weeks, of CD19$^+$ B cells was 5.24%±2.68%, and of CD41b$^+$ megakaryocytes/platelets was 4.3%±2.0%, with CD14$^+$ monocytes at 1.71%±2.36%, CD66b$^+$ granulocytes at 0.51%±0.46%, CD235a$^+$SYTO60$^+$ nucleated erythroid cells at 0.22%±0.13%, and CD235a$^+$SYTO60$^-$ enucleated erythroid cells at 0.08%±0.05% (FIG. 61, n=6 mice). The percentage of CD14$^+$ monocytes was 2.1%±1.81% in the peripheral blood of miCD34$^+$ HSC-transplanted mice. Additional flow cytometry failed to detect the primary phenotype of undifferentiated miCD34$^+$ HSCs. There were few to no human CD34$^+$ cells in peripheral blood (0.07%±0.04%), spleen (0.04%±0.03%), or bone marrow (0.01%±0.01%) of miCD34 HSC-engrafted mice at 12 weeks (FIG. 62, n=5 mice).

Figure 63:
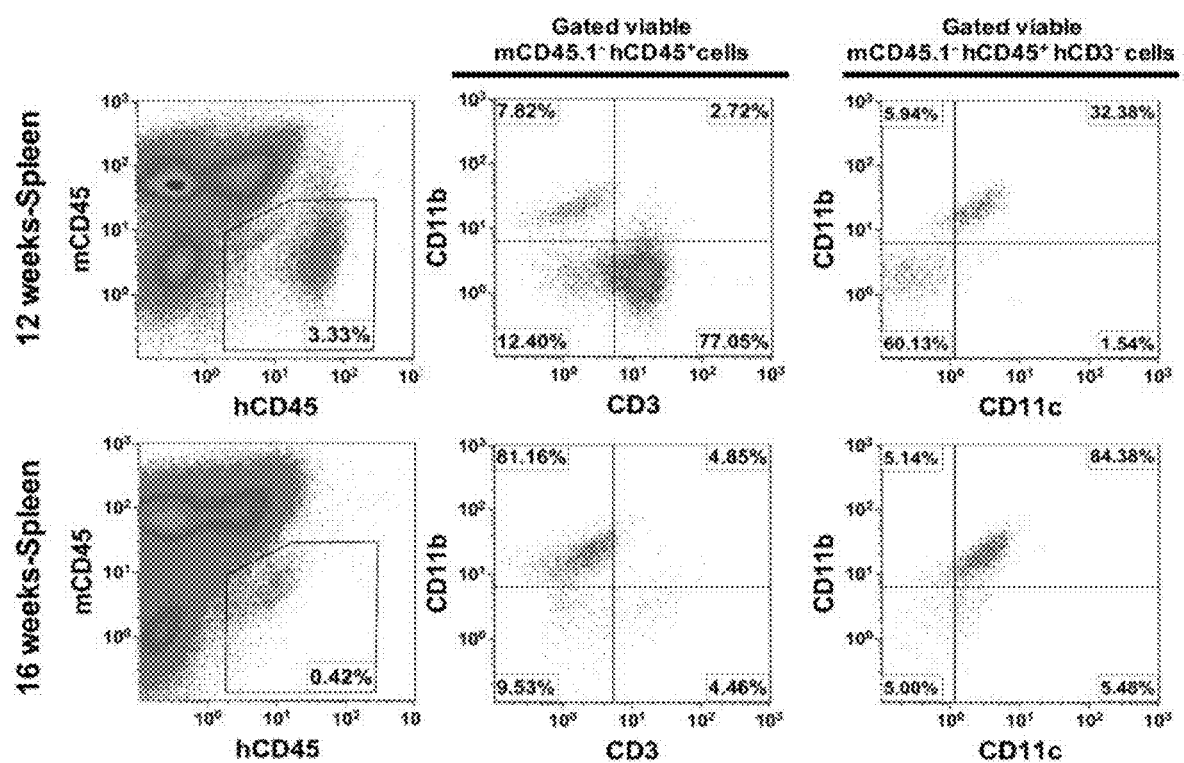
FIG. 63 shows myeloid differentiation of miCD34$^+$ HSCs after transplantation into NSG mice at 12 weeks (top) and 16 weeks (bottom, n=3).

To further confirm miCD34$^+$ HSCs giving rise to monocytes/macrophages (myeloid lineage differentiation), an additional animal study was performed in miCD34 HSC-transplanted mice at 12 and 16 weeks, respectively, by using macrophage-associated markers anti-human CD11b and CD11c mAbs. Flow cytometry demonstrated that the percentage of mCD45$^-$hCD45$^+$hCD3$^-$hCD11b$^+$hCD11c$^+$ macrophages was 75.22%±18.33% in the splenocytes of miCD34$^+$ HSC-transplanted mice at 16 weeks (FIG. 63, n=3). In contrast, the percentage of mCD45$^-$hCD45$^+$hCD3$^+$hCD11b$^-$ T cells declined from 59%±14.01% at 12 weeks to 4.05%±2.87% at 16 weeks (FIG. 63). Thus, the data demonstrated monocyte/macrophage (myeloid) differentiation of miD34$^+$ HSCs after transplantation into irradiated NSG mice. Considering other lineage differentiations (e.g., T cells, B cells, megakaryocytes and red blood cells), these data indicated multi-lineage differentiations of miCD34$^+$ HSCs.

Example 11

Figure 64:
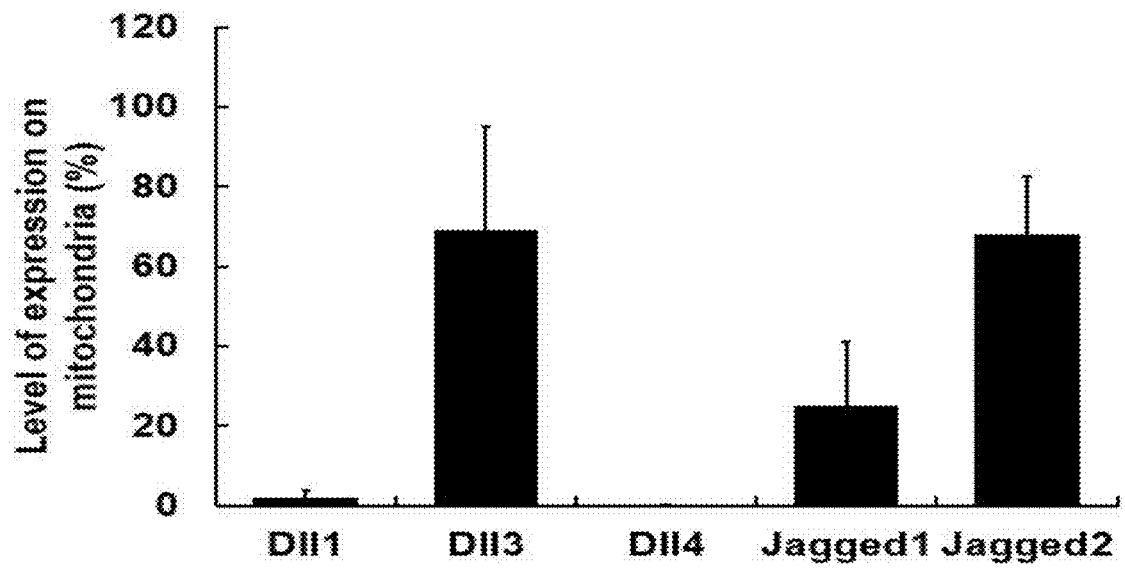
FIG. 64 displays analysis of Notch ligands on platelet-derived mitochondria by flow cytometry (n=3).
Figure 65:
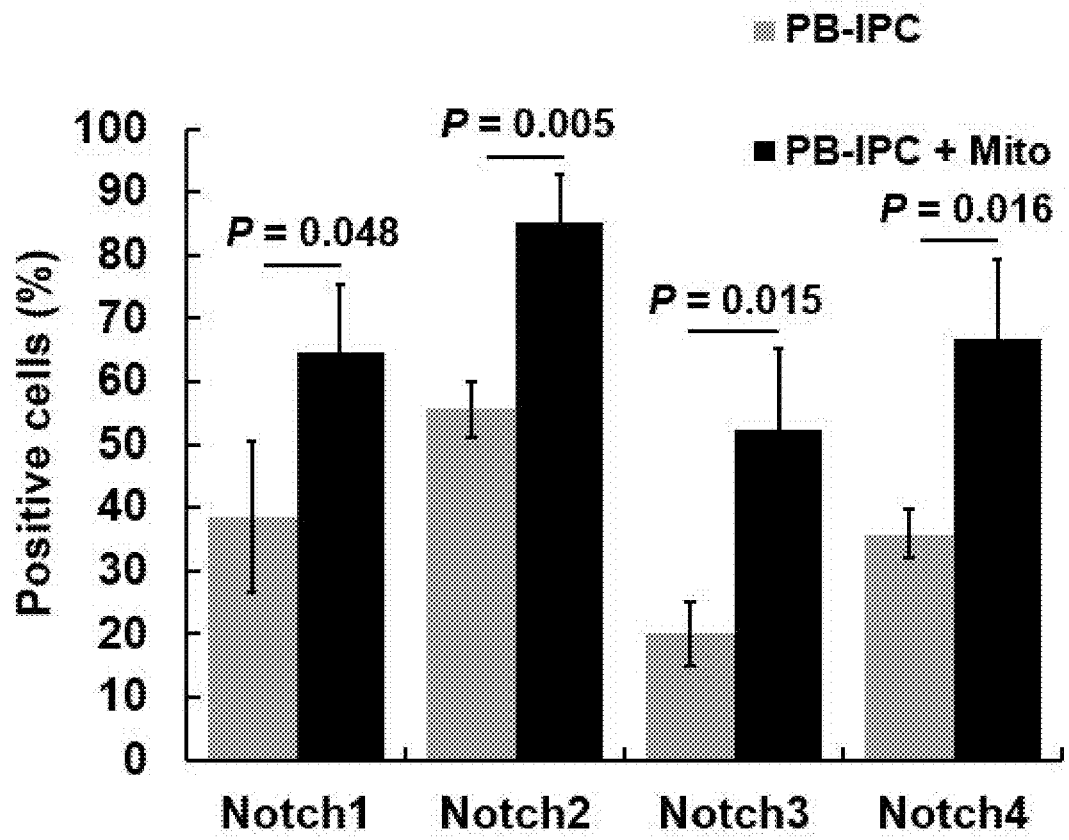
FIG. 65 shows expression of Notch receptors on PB-IPCs by flow cytometry. PB-IPCs were treated with mitochondria for 7 days and collected for flow cytometry. Untreated PB-IPCs served as control. n=3.
Figure 66:
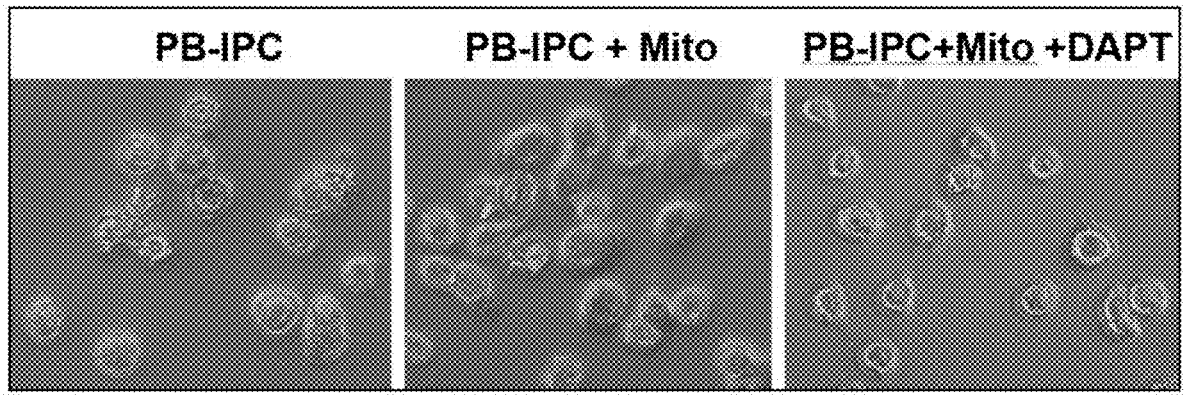
FIG. 66 is phase-contrast imaging showing the morphology of PB-IPCs (left) and treated PB-IPCs in the presence of mitochondria (middle) and mitochondria+DAPT (right). Original magnification: ×200.
Figure 67:
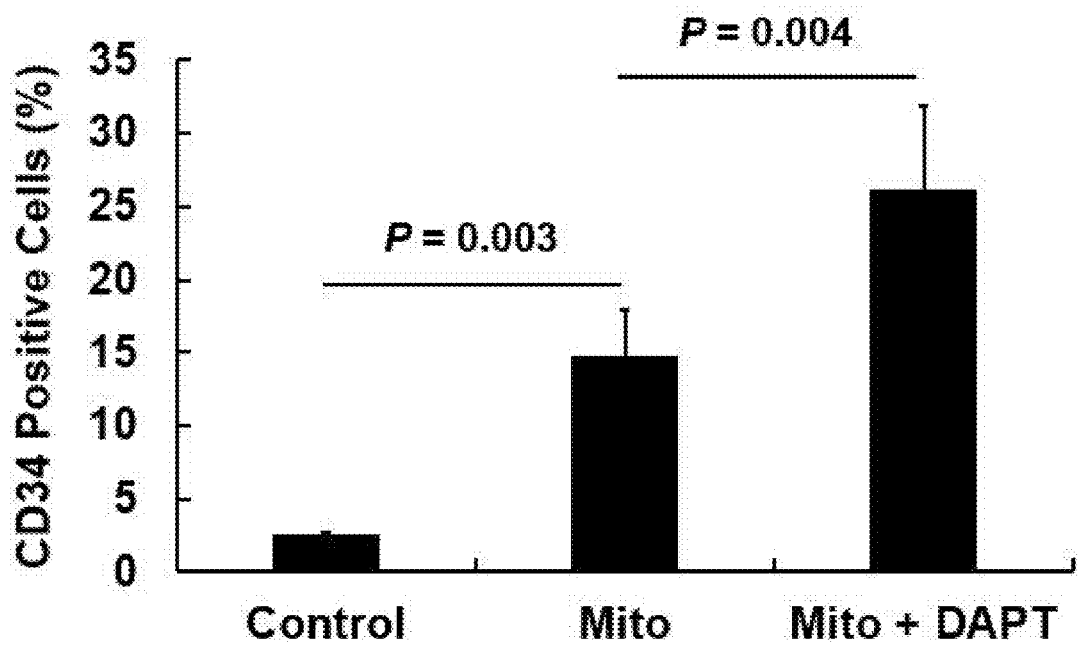
FIG. 67 shows CD34 expression upregulation after the treatment with mitochondria and/or DAPT. DAPT-treated PB-IPCs served as control. n=4. Data represent mean±SD.

Notch Signaling Pathway Contributed to the miCD34$^+$ HSC Differentiation after Treatment with Platelet-Derived Mitochondria Notch signaling has been well established as an essential regulator for HSC generation and differentiation. Specifically, the Notch signaling pathway plays a crucial role in T-cell development and maturation at different stages. Both ex vivo and in vivo data demonstrated multiple differentiations of miCD34$^+$ HSCs. To dissect the molecular mechanisms underlying mitochondrial treatment, the action of Notch signaling during the induction of differentiation of PB-IPCs toward miCD34$^+$ HSCs was explored, as illustrated by FIGS. 64-67. Flow cytometry revealed that mitochondria expressed Notch ligands Jagged 1 (JAG1) (25.13%±16.0%), Jagged 2 (JAG2) (68.04%±14.6%), and Delta-like 3 (DLL3) (69.3%±25.96%), but DLL1 (2.21%±1.74%) and DLL4 (0.23%±0.09%) were not expressed (FIG. 64). The expression levels of Notch receptors 1-4 on PB-IPCs were markedly upregulated after treatment with platelet-derived mitochondria (FIG. 65). To examine the role of Notch signaling in miCD34$^+$ HSC differentiation of mitochondrion-induced PB-IPCs, N—[N-(3,5-difluorophenacetyl)-L-alanyl]-S-phenylglycine t-butyl ester (DAPT) treatment was used to block γ-secretase, an enzyme critical for the release of the Notch intracellular domain (NICD) into the nucleus to initiate gene transcription (FIG. 66). The percentage of CD34$^+$ cells was significantly increased in the group treated with mitochondria plus DAPT (26.2%±5.68%) (FIG. 67). In contrast, treatment with DAPT alone showed a very low ability to induce CD34$^+$ cells (2.59%±0.13%), indicating that mitochondria are required for miCD34$^+$ HSC cell differentiation.

SEQUENCE LISTING (46 sequences)

SEQ ID NO: 1 - DNA, 9881 bp, Artificial Sequence
  Based on Homo sapiens sequence
cacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggagaggtcaccttcttcttgggcgagctcttcttggggtgctgagaggccttcggcaggtcatcacgacccctccccatttccccaccctgaggccctctggccagtctcaattgcacagggatcacgccactggcacaaggagacacagatgcctcgcaggggatgcccacgatgcctgcatgtgttgcttctggttcctttcctccagttccaaccgccgcactctcccacaccagtgtgacagggggcccatcaccctagacttcagagggctgctgggaccctggctgggcctgggggtgtagggccaccctgcccttccccacctggaacctggcacaggtgacagccagcaagcaatgacctggtcccaccatgcaccacgggaagagggagctgctgcccaagatggacaggaggtggcactggggcagacagctgcttctcaacagggtgacttcaagcccaaaagctgcccagcctcagttccgtcagggacagagggtggatgagcaccaacctccaggcccctcgtgggggtggacagcttggtgcacagaggccattttcatggcacagggaagcgtggcgggggtgggaggtgtggtccctagggggttctttaccagcagggggctcaggaactgtggggacttgggcatggggccatcgactttgtgcccagccagctaggccctgtgcagggagatgggaggagggaaaagcaggccccacccctcagaaaggaggaaggttggtgtgaaacatcccgggtacactgagcattgggtacactcctcccgggagctggacaggcctcccatgtgatggcaaacaggccgacaggagacacggctgttgctcgtcttccacatggggaaactgaggatcggagtcaaagctgggcggccatagccagaacccaaacctccatcccacctcttggccggcttccctagtgggaacactggttgaaccagtttcctctaagattctgggagcaggacacccccagggataaggagaggaacaggaatcctaaagccctgagcattgcagggcagggggtgctgcctgggtctcctgtgcagagctgtcctgctttgaagctgtctttgcctctgggcacgcggagtcggcttgccttgccccctccggattcaggccgatggggcttgagcccccctgaccctgcccgtgtctccctcgcagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaaggtgggagtgggtggtgccggactggccctgcggcggggcgggtgagggcggctgccttcctcatgccaactcctgccacctgcagggaccctgaaggccaagaacttcaagaagagatgcctgcaggccaccatcacccaggacagcacctacggggatgaagactgcctgtacctcaacatttgggtgccccagggcaggaagcaaggtctgcctcccctctactccccaagggaccctcccatgcagccactgccccgggtctactcctggcttgagtctgggggctgcaaagctgaacttccatgaaatcccacagaggcggggaggggagcgcccactgccgttgcccagcctggggcagggcagcgccttggagcacctccctgtcttggccccaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtgcgtgggtgccttcggccctgaggtggggcgaccagcatgctgagcccagcagggagattttcctcagcacccctcaccccaaacaaccagtggcggttcacagaaagacccggaagctggagtagaatcatgagatgcaggaggcccttggtagctgtagtaaaataaaagatgctgcagaggccgggagagatggctcacgcctgtaatcccagcactttaggaggcccacacaggtgggtcacttgagcgcagaagttcaagaccagcctgaaaatcactgggagacccccatctctacacaaaaattaaaaattagctggggactgggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggactggggcaggggcaggagaggtgcatgggcctgaccatcctgcccccgacaaacaccaccccctccagcaccacaccaacccaacctcctggggacccaccccatacagcaccgcacccgactcagcctcctggggacccacccactccagcaaccaacgtgacctagtctcctggggacccaccccctccagcaccctacccgacccagcttcttagggacccaccatttgccaactggggctctgccatggccccaactctgttgagggcatttccaccccacctatgctgatctcccctcctggaggccaggcctgggccactggtctctagcaccccctcccctgccctgcccccaggtaactatggccttcgggatcagcacatggccattgcttgggtgaagaggaatatcgcggccttcgggggggaccccaacaacatcacgctcttcggggagtctgctggaggtgccagcgtctctctgcaggtctcgggatccctgtggggagggcctgccccacaggttgagaggaagctcaaacgggaaggggagggtgggaggaggagcgtggagctggggctgtggtgctggggtgtccttgtcccagcgtggggtgggcagagtggggagcggccttggtgacgggatttctgggtcccgtagaccctctccccctacaacaagggcctcatccggcgagccatcagccagagcggcgtggccctgagtccctgggtcatccagaaaaacccactcttctgggccaaaaaggtaaacggaggagggcagggctgggcggggtgggggctgtccacatttccgttctttatcctggaccccatccttgccttcaaatggttctgagccctgagctccggcctcacctacctgctggccttggttctgcccccaggtggctgagaaggtgggttgccctgtgggtgatgccgccaggatggcccagtgtctgaaggttactgatccccgagccctgacgctggcctataaggtgccgctggcaggcctggagtgtgagtagctgctcgggttggcccatggggtctcgaggtgggggttgaggggggtactgccagggagtactccggaggagagaggaaggtgccagagctgcggtcttgtcctgtcaccaactagctggtgtctcccctcgaaggccccagctgtaagggagagggggtgccgtttcttctttttttttgagatggagtctcactgttgcccaggctggagtgcagtgtcacgatctcagctcactgcaacctccacctcctgggttcaagtgattctctgactcaacctcccatgtagctgggactacaggcacatgccaccatgcccagataatttttctgtgtgtttagtagggatggagtttcatcgtgttagctaggatgatctcggtcttgggacctcatgatctgcccacctcggcctcccaaagtgctggaattacaggcgtgagccactgtgcccggccccttctttattcttatctcccatgagttacagactcccctttgagaagctgatgaacatttggggccccctcccccacctcatgcattcatatgcagtcatttgcatataattttagggagactcatagacctcagaccaagagcctttgtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaaacctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcaggggaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaaattatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 2 - DNA, 32377 bp, Artificial Sequence
  Based on Homo sapiens sequence
ctggtcagacacaatgttggcactcttggttctggtgactgtggccctggcatctgctcatcatggtggtgagcactttgaagggtaagtaagccatctttaaggagcaagtccttcttccttgctagcccccaaatttggacacattactcatttccaattctctgtgcttctattatctcattattcagcgagaaggtgttccgtgttaacgttgaagatgaaaatcacattaacataatccgcgagttggccagcacgacccaggtaagtaacaattttgatttacttcacatctaatttaaaatcttagatcgcactgtgattccgacaatggaaaaaaaaacatgaaatattaactatagcattttggtagcaagaaataaaaacttggaaaacatttagtgccataatgtcttctttttctgcctaaattagattgccataagccctgtagtattataaatccatggtaacttttaaaagagctgacagtgtgacaactggatgagttgcaactgtcacgaaggtcacagaacatctaatgtacagtcactttccttctaaggcaaaagagaaaaatgatcaacttggatattactgaaaaactgggcttttgtccaacttcaaattcatttccacatcccatgtatcatctgtcctctttgattttctttcattccaaatcaaacagcttgggttttcatgaccttgattcaggtccccttaatgatatgacgtgagggggaaaaagagggtaaaaagccatgagtgattttcatacttttcttttgctttcaaaaaactgacatctctgtgctaattttttaatccactatatatgaggtgagaactgacattttaaactgcgtatacaatgtggcaggaagctattgctgaccacaaatacagtagttccacttgggccaatgccgtttcttcataaatatataaactaaaataatctgctagcttatacacacacacacacatatacatacataaacatatatagtcattttgtagcttttaaggcatagaggaaggaagaagaaggtggagagtgtcataatcacaggctcagaagttcagaattgaaagaaatataaactcatctattccagcaatccactcaaatctggaatttccttctgggaaacagcatccccagttactactcctggtaaaacctgtttgagtacttccaggaatagtttgtatactactttttggaatagcccacttgccttacaaatcattccaactgttttcttccttattctgagctgaaagcttccttctctaactttgacctgttgggcttagctgagtcaaatatcatgttacctctaagatttatctttttcaagctttccgtaatttttcttagcactggtatacagactcttgatcattctgctcagatctagatacagctcagtctttctgtctatatttctttttttaaatgtagttaccagaattgactatggacctccaggtgtgttctgattaatgtatactacagggccattgcttgccttcatttgtaaagcagacatttattaatggtgcctaagattctttttagcatcttaaacagtcatagaacactatgagcttatattaacctgtgttcagtcaaaaccattaggtaattttttttcctcacatgaatcaccctcaaacaggatgtccctccttttgtgcttacctaattgacttttttcacctaaatgtaggattttagatttacacttttaagatttatcttgacagcctgttttcagcatgttgagatcttttagaaaactaattcagtcatccagggcaataactcttcccctaactttgtctctccaacaagtttgataatcatgtctttttgacttttatccttgtcactgataaaagaaaacattaaataggtcaggagtcacagaattagaggccttctttacgtttcactcattcagtacatatttatcatgaatctccaatgtgccagacatagtgttaagcactgaagagattcattaacctattctgcttgcataagtttactcaactacccaagctaggggggtgttacctaggggtaactctgcctggtgctttctggtttataaagaaagatatcaatgcagagacttcatcaaatgctttactaagatcaagattcaacattctaccaggttagtgctctcatccaaaactaaggtgaatttaattgggcctgacttattcttgctttaaaccatactggctcccagagaccacagcttcctttcctcagcattcacaatccatctgcttccagttcactctgcagctttgccagaatccatgccaggccccagcagctcctgcttctgggcttcacctgttttcgtgtttataaaatctaaaacttgccccctctactcgccagtgagcccttcgagctctgattcttccaagattgctgagaaagttctgcaatcacatctgcagtatttttttagttatctaaaattcagcatttcatagtggtcaagagcagagagtctggacttagactgcctgggttcaattcctagcctttctacttgttagtcaaacttggacacctctctgggtctcaacttcctcatttgtaaaatgaagatgataatactatttacataggagattgttgtgagaggtaaatgaattaatataggtaaagcaattagaaagaacttaaatagtaagaattatatgtgtttgctgttactactatcattaggtctgggattttgaatacaatttatatggctagtataatcaatcacctatgtcctcatctaccttgggcctcaatgttctctttccaaagaaggtatttctgtttaaatcataacatgaaaaaatctttacttatccttgtggtaatttcatctctcagtagtaatagaataaacaaggaatagtgtaactctctcttggaaaagacagaagccaaaaaacagttaaatagggcttctttctttcctctggctgcaaacatcatgctttagctccaagcagtgggacacatatttcttctttattcttttattttcaacatgattgaaatgagattttcattctccttagcagttacgggaacagcatattctgggctgtagccttcctgataagatcattacaagggcatccagtctttgtattcatccttggccatgtgtccttcctctcagcttttgaacatgtccttttaaatgctgaatatattgggcagatccgtgaccacactgtactccagcagcccttcttttgtcatctataattgaatattaaggattttattttatctcctcacaatcagggttgtgcttgttcctttattgaaggcattcaccataaaacctattcacttttctctggactgtcttgaagtctgtgtttctcaaatttaaggtgcatttttctctatgcctggagtaacatggttactgtcttccaatgttcttatcattcctactgtaccagtaagttcctcactgctgtctggaattgggccttgagtagaagttgttttcttttccaacaaaaaaggaaaatttcaccaagataaatgaaaagtctatcagatgtttgacttacagtcaaatgcaatgtgaagaaacaaattcatgcaaatttttgaagaaaaaaagatccccaacaccaatatttatttttttattggccaatcttattcctggaaaaatttcaggttggcatgctactttatcttgcttttaggctagttttctgagatattttaggaaggattctttagttgttaggcagccggctgattaaattgatattcttataatgctatcatttaaagatatctcttgatcatccaataagtgttctatatggttctttgtcacatttataattttataacttcagttttctaacttcataatgtatagtttaattccctacatctacatcctatatttcactccatgtttatatttcagacatacatctcattcacaaggtcctggtaatttctgaaatttatatttatcaccttatgttattactttgactttattacctatattcatatttggtgcattggtaaacagctgtgaggctatagcattgctcctgatttccagccatgtttctcctaggaagtatcagagactaactccagtatagtgggtctgtgtcacacatgcaacactccagagtgttgtatgtatgttgataggtttgctaactggttttctccatgtcaaactgaaatttttaagcaacctcaggttagttctgtaagtttctgtcaaacatatttatgagatttatttgccccatcttaaagaatccataattcttgcactgaaatcttaaaagtaacactttctctaaatatatagactcttctaatatttggcagagctaggaccaatgggtaagagctgaggaggatacagatgacaattttcagtttaatattagaaagaaaaccatttataagcaattaagctgttctgaagtggcactagatatacacaaggttctgctagaaccaccaccaagaacatcatgcaagcatttaatgctttgagtggaaagctagcatcttaatacaggctcttccaaagcagaccctgagacaaagattcaagggaaagaattttatctgggaagtgcagggagccctggtgaagaagtggggagtgctaaatagaagtaaaggcagccaacaaaggaaacagtgttaagccagctaccacagaggacaactggcggtaaacccacagggaaactctaggaatgtgtgcaaacaacacacttcagaattatcccacctgagaggtgaaggagttggagtaattcatcattcgcttttcaggattcttggttgaaccacaaagaataatttccttggtaccgcctgtctacctggagctgataacttggcttttcccagttctacaggaaagagccctcaggtacagagaggcagatcttagcaaggggagtacactgagcacactaaaaggtcccagcaattatgtgccagcgggacactgtctggtcagctacagatacatggaggactttatgtgctttgccaattctcaaccttgtcgtctataataaagacatatctctctctcccaccacaccatagaatgacaggtgtttattaggaacacaaattcagagctaagtttcaaaaatatgctttctcttataatgtgcttatcttcaattgcccttctctccacaatgttggctaactagaagttgtcaccagccccttgctttctctgtccttatcttagcatgtctttatacttcctcacttcatttaacctctcatccttgactcactaggtcaccttctacagccaatccttatccaaacattgatactctatcctttcaatccctttgtgacaacctcactcatgcttttttcttctggaacaccagtatccctgcctcccattgccctgacattccttatgggcctgattcgtgactcaccacctctagatttctacagtggtttgaagcttaccaggacagaatataggttactgggagccccacaagtgtatctgaaactgagatgccttacagtattaccttgtcagtttctgctgcataacctctaagtctgcccaaactcccttccaagtttccaatcagtggtcctaaatatcaccatcagacatatctctagccccaaagcagtgcgcaaacatccgaacagagattggctgagacacagggagaaagaaagacccaatgtcaggctgacctcagacttctaggcttccactcggcacaagcaaggaagagaataacagacacctacaagacacagtatgttttagttaatatttttccactgaaaggtgttacttaaaaccacacatccacagattaaaaaaaaaaaaacagctatttggggcttcatcttctctaatgtctcccccataaagacaaaggccatgtttgatttgcccactaatgtattcctagtctcagacacagagcctagcatatcgtaggttctcacaatagttgatgagtaactgaataaatgaaaatgtcagtacatgactggatccccaagagcaatttgtctccagccacagtgtcaatatacccattgtgaaaagatgccatttttcttcctgatgtatccaccacaggtcagggatcctcctggttccacatattactgtgacttccaagataaactcataaaataagtccattaaaaagtaaaacagcttcatatttctccattaaattttgtaattctagttaattcatcattcatctggcacatagatccattaccacatagcatctattccaacaagttagtgatccagaaaatcaataaatagaaaagaacagttacagaatacaaccaactagcattatgggaaatgattctatgttttttcatgttcattgataatcaatcaaggttatgtatatatttgttaacacttttatcaacatctaactgcttggttccaacccttgttcactcaaaggaaatattttcaacagatttcatggatgatttgattttgaaaataactcaattcagtagagcaataatgtgctcgcagattatccttcatccattgaattataggtatccaatatatcttgtcctttattcagattgacttctggaagccagattctgtcacacaaatcaaacctcacagtacagttgacttccgtgttaaagcagaagatactgtcactgtggagaatgttctaaagcagaatgaactacaatacaagtaagtttatgttttataaatattaaaattctctcccatgcatgctttcatctgagcctttgaataactctgggaaggaagaaatgagaccaagaccaatgccttccccaggaccccacaaataggtaatggcagagctggccctggattccaagtcttaagacttcagttctgatggattttgtgtttagttattgctctaattaaaatggtttttattcttgaccccaagtcttctgccagatatctgacttggtccattttacaagcaatgtatagagtacaggcctagccaatggatactctattctcagctagacatagttttaaccccaaatcttatcagctcttctttccaggggatcagcgagacctattgtgagttatgagggctatttgtgctttttttagcagaaggataagtctagagtcagtctgaatggcccttctgtccttttttctctaaagtcccaccactatctctaatggtaggagaaggcatggagagaaagacgcaaagaaaggactagagtagttggctaagctgatcctgtctccctcactgaataccactttcgttcatctaggtctttcatgacaagaatgtcttcctaagtaaaggcaattgtccatttgctgatccaacaaatcaatattgaatgtctacatgtatcaagttccaataaggacagatatgacctcacatcctttaggggaaaacagactttaaataaggaattgcagtagtatttaacagatggaaagaagagtaaagtgctggagttcagaagaatagagcaagtctaggggtcagggagggctgtcctaggaaatgattcttcagctgagaactgaaagatgagtaggagttgattagccagaaaaagacaaggaaaaaccatactttaggaagagaacagaccatatgctgaggcttagaagtgggagagaccatgctaacccaggacacttgcataagagggaaggaggaaataaagtctctagtacaaagcagaggtcctcctccagggggtagattagggaggaacaaagacaaagtcttgggctccggtcctgaacattcaaatgtttatccggcaatcccccatcacaagctcaagtcttcattatgttttggaagaatgtagcctatataattttaacagaaatttctcttgtttttcacgtcttaaaaatgtaaaagaatagtatctgtgccagtgaagatgtcagaattgtcacctataaaatctgtacctccatcaggagaagtgggtagcatagtgcaacaagtaaaggctttgggaaaaaaacagattagattctaatcctggctttgcacattgctgtgtgattgtgggtaatttgctcaacctttctgagcttcagctttcttatccataaaatgaagatacaatgcctctctcaaagggctgttgtaaaaataaaaatatatatataaataaattacaactggtattatattgctgagaatgctgctatggtttactgttgtacaaagaaggagattatacgtttttttttttaagagtcaacagtaactgctatgtttaaccccattatcatgcctcacaaagcttagctatgtgctttctgcctgaaggaagtgtcaaaatgtgaccttaagaattgactgtctttttaaaacaaagatataacctggtaagtctcaaaatgtgattaagattcatgtctataacattttgctctttttattatactgaaaaggacagctaaaattctagtccttggagccttcagtagcattcaaaaagatgagtttctttgtaattctttaagaaaaacaaagatcagcgaccatagattaaccctagctacctgaatgatgtcttaattctacccttatcacaaaacagtaaaatggtttctgatagaatttcaatctctatttataatcagatagaaagttcactttcttttttagtggtgaactttttgggaattgtgtatgaatgttgtctcatctagaacataggacatcccctgagggctaagagcttgttaatttttgcttcgctgttcactgcttagcacatttgtagcatataattttctaaatattaaataataataagtccctggaaatcctggagaagcataccagcaatatccttgctggggttgcaagcagtccctgtgcatcccattattacctcatatggtaactagtatttagacgatttcctgctggcaaaaatttgcagtagtgtttgtatataacaagagccatccactgcacacaagttctaccaaaataacttttcagattttttcagtgtttccaaccctcttcaccaagacctgtattatttggcagctttaatcagatcctgaattatcataggaaaaaaatcaaaatgtgtgcaaaaagaaagataactgtaattttcaatgacaaagtttcactcttagtaacagaaagactaggaatcagatagtgtaaatctccaacttatggttatgaagctaagttgacagaacctttaggtggcctgccctccatggaattccttgctacagactgtagaaagattgctttgccctacttgattcagggagactgattgttgctcacacgtatatcagcatttttctgcatatttcagaggcgtacaggaaggtgtcccaggacagcaataggcacatagcaatgttcttcaataacagtgggcgcaaagtccaggtactgatcaaatattctattttccagaaatctgaaagggggataaaactgagtcatgtctttctttacttctcagacattgtgttccttacttttttgggagtcccagttatctaatttgcttgtgtgttagaaaaaaaaaaaaaaaaaggagaagttggatggcactataaaacgagcatataaaagtataaaatactatacatgcttctctattttggagctgtgaggcattgttttaatcttctagaatggaagctcattatttagtaataatattttgtaatatagctaaagtagtactttgtcctaaatctaataaaatcaaataaccacagggctgggaaggatcatttgaggtcagtcccccgccttcaagcagaagtcagcaacacatttcaacctcactctgatgctcttttgcaagttactagaggatatttttactcttgggtgtcatcttcaatttaactaactggttttttatgcttctttgtcctggatattgatgaaaatgtttaatatttaaagtagtaataactctaacagaatgtctcttagtaccaaacaaaatgccagcccccacacagtcactgatcctcctaaataatttaaactcggccaggcgaggtggctcacacctataatcccagcaccttgggaggcctaggcaggtggatcacgaggtcaggagatcgagaccatcctagctaacacggtcaaaccccgtctctactaaaaatacaaaaaattagccgggcgtggtggcgggcacctatagtcccagctactcgggaggctgaggcaggagaatggagtgaactcaggaggcggagcttgcagtgagccgagatcgcaccactgcactccagcctgggcgacagagcgagactctgtctcaaaaataaacaaattaacaaaaataataatgataatttcaactcaagggttgggtgcaggtaagaggatagcaatatgttctggaagctttgaaatgaaagaggatgtcattttctggtcctcttgggtttttttttttcgttccgagaagctcatccttattaggtaagatttgttctttcacattatgatatcgagacataattgtcctcttagcagtttctgtcggttgatttttttgtttgtttccaggtttttgtcttacttggcttgctttgttttggtttggttagtctgtttttagttttttgttatccttgaatatcattttcctgaactattttttagttttcctccacgttttcctgagttatgacagtggtaactgggaaatttttatttttttcataaacttggaagacatgtatgtaaatgactaaggcttatagattggaatcaagtcactgcattttagaattgaaaaggatgttggatatttactaatcaaatgacccccttctaaaacttatgacattaaggtccagggattagatgacttttctaaagccaatttatgagttaggcaaaactatgaccttgatcttttgattcctcattcatgattccttctacttccaccctattccttaacaattcaactgggatagtaaatataattatagtgctgactaaaatcattgttcctaactataagagacagactgatggtccccaaaaaactctacagaacatgtgaatatgtcatgtttatcacaaaaaggaatttaggttatagatggaattaaggttcctaatcagctgatgttaaaatagggagattattctggattgtcctatatgtccactgtaatcatgagtctttaaagtgaaagagagagggagaagaggtcacagtgattggatgtgaggactttatcccctgttgaagccttgaaggtggagaaaaagggtatggccaaggaatgcaggcgacctctcagaactagaaagggcaaggaattagattctcccctagagcttccctgttgataactcttttttggccacacctcatttttatcccagtgagacttgtgttggaatgctaacctacagaactataaaataaaaaattcacgttgttttaagccactaagtctgtggcaactgacaagagccatagaaaactaatacactcacaaagcattggcagctgctcaatagaaaatatttctccatggaataacttttaaaatctgcattttttcctttttaaatactaccttaagatagttaagaccttaagaaagtgtttatcttttgctaggaaacagattccagttagtattaatttattacactttccaaaaacagacacaagttcgtacccaagttcaccaattgaaggagtgaccaggaggaaggttcagaggatgtccctgacatacttcatcagaatgtccttggggcagccagaggagaagcagacttttgatgtgtgtctgaaattctctgtatgtcagataaaatcatttcaaggtttaactgtggataatagaaatttctgcaaagtggcctctgtctgtaatattcactgtactgtgatcaaggatactaatgatcataaacttttctctcttccaagcatacttttcactcaaagtagaaagggaagtgaagtcacacacacatacacacacacacacacaccttcagactggcctcataatagaaactatcacctggacaattcatttctctaaatagtaggcctcaaagatttctgttaccacttttcatattaccttgctacagaactattattagattacttaacccacccaaaagacaagcaaatagaaactagttttttaaacccattcttcttttaccaagtaaatcttcagcttgttaatatttctgaatttccagacaagatatttttctcagaacctagagacaggtccaaagtgacaactcctcccatttacccaggactgagtagcttcctgaaacgcaagacttttagttctaaattcagaaaagtcctgaggaagaaagaccaaagataggttttgagtacatagtgttgtgtggaagcccaaggccctgacccaaaatgtcccaggtaccaggagcaaccattttccaagtttaaggttcacagatagtcaaatacctgaggtttgggctgtggaagatcctaccttgcttgcattctccagtatccttcttagtgacttactcactctttatggtcagtaacagaatctctctggagcagctgaaggtcatcaggaagaaccagaggacaacatgagaatttatggagagtgcaatgtgccatctactaaagcagtggctctggggttttatgtgtgttcactggagaaaaatacacttatgttcataggaacacccactttggttcgttgcagggtactgataagcaacctgagaaatgtggtggaggctcagtttgatagccgggttcgtgcaacaggacacagttatgagaagtacaacaagtgggaaacggtatgatgtgcacatgatttagacagatattactttgggaattgaaccaagaatgccacattgatctacaaatgattccatttggtagatagaggcttggactcaacaagtcgccactgagaatccagccctcatctctcgcagtgttatcggaaccacatttgagggacgcgctatttacctcctgaaggtaatcatttttaaccatgaccttgccatgtctgagggctttaaatcaatgaattctaacacatgaacatctgtttcacagacacgcttatcccaaacattgttataactctttcctgcctacatccccgagggaaccagattccccagcttcttttatcatatgtggatttttaaatcattattttgatttattcaaaaggaaaaatgcaataaaataagagaagacctataaatttaaccacattcttgtaagcaacgtaaatgattatctaccttgatgaaattcttctttcccagctgtggtttgcaaatccatttttaaagaggttcataaacttcatgtctatcagacaacattacaaagcacatcaacaatttgtttctgtcattttctaacaccatttttgtcacgtaattctaatgaaggaaataaaaagacagggaataagtgagagagtagtaaaaattcttacaagattagcgacaatcatgattacttctaattactcatccagttgtcttggtcatgtcacctaataacagcagctgaaaataacctccacatgagtacaattaagcagggtaatcaagcatcatctgaaaatatgagcttgtcaagcttaataaaaataataaacagccatataagctttcagctcaaacattgtgagtctagaagcgagaacatactgtgttagtattatattttaatttaatcatgggatccagctcttgctgctgtcgggtttcacttgttgagtctcaagcccagatgggtagtggaggttaacccctgaatgtcctatgatgaatcatggtttcccttttccttttgtttgcaataggttggcaaagctggacaaaataagcctgccattttcatggactgtggtttccatgccagagagtggatttctcctgcattctgccagtggtttgtaagagaggtcagtgtgtagagtggtttttggcaaagagaaatgtatgttttaattttcaattaattccttaaaacctagagagaataataacacagaaaaaaatacacaattacaagtgcccaattttggaaattagtttcaacttccaccaacagacctttataaggcagaaaattctatttatgggccaggtgcagtggctcatgcctataatcctagcactttgggaggccaaaacaggtgaattgcttgggcccaggaattggagaccagcctgggcaacacggtggaacctcatctctttaaaaaaaaaaattgtatttatttgaatttcactcatctgaactttctcacccacatttggtagagagtccaacaactagcatagtgattggtcatgtaaaagctaatggttgtggttaaaccaatttgatcattatctcttggctaataatcattgtacacttcagattaaaagaaaagagtgcatagtagtccttactctaaatgacactgtttttcattccttatcattctaataataagatgaatgtaaaggccttttaaaaacaagttttaaaatatgcatgagtctatactgatatgcatagatgatgcaataaataaaagagaggcaaagaacaactccttcttgcagaagaattacaactaatatatgtacaaagaatgagcaaaacataaaatcatcactagaacatcacagcaataatcatgtcaggcaaatccacagatggatgtaaaattagtgggtaaaagtttagggagaaacaggatatttacagagtctaaaagttatctcctcgcaaaaagtattaattataaagggaaaacttagagtggataaacctagcagaaggaactaccttaactaagtgatcaaggttaacatcaccaataataaataagacatatcaatataacgtagcttcagatatgctgtgaaaagacatatcacctttgtgatattcttccttaaaataaatgacctccctttaatcataaacaaaatttaattttgaaaaataatttagacaaactcaaagtaagggacattctgcaaaataaactgaccagcactcttcaacagtgttaaagtcataaaacacaaaaagactgaagacctgtcacagatcagagaagactacggagacgtgacaaataaaggcaatgtaggatcctagattgtaacctagaatggaaaaaggacattagtggataaacttgtgaaatctgaataaagtctacagtttagtttatagtattgtatccatgctaatttattcactttaataattataccatggttgtgtaagatggtaacattcaggaagctggatgacgggtatgtgggaactacttttgcaattcttctgtacgtctaaaattatttcaaatttaaaagttgaaaacattgaagtgctttaaatatataataatattattatatacaacataatttttgtgtgaagcacttccgtacatatttgttatgtagtcttggtttctagacattatgtatcagattggcatcacttagcttcactatgtagctcaccatctgcctttcagaagaggataactggatgttagaattaaattttactatttttccaatttgtagaccattaaaagaacatgattgcatagctcctccaacccaaaaagcacatgctttatcatgtaatattgtaattaatttatatatataattacaaacagtatataaaaactgttcacacatagaagtctaatctactttaaagtttattcaagcaagcctagggaagggttgaatttaagtttaatatgatgctggagcagagggactgtgactacgagaacatattaaatgggcatgatgtccctcattcatagataagtatctacattatttaacagggacaacaggattgtcccttcttgagaaagacaacaaaggaaactcccatcactatgcagcttggagtgttggtgagagcctccccaaaatccatgagtgtgagcttattttgagaggcattctcattaccttgttatattggacattccctctagtgagatcatctacaggaggttttatagaaaagaaatacatttctaaatgacattattaggaacatgcacagctatccacagacacgtcttacttactagaactagtaagttctataccttacttacacttataccctactaactttgtaaaaagctattgtagttgttatcttaaaagaaatgagtatatatgttctttagaagtctttaattaaataagtttctcattaaagtaaaaagttaaaataagaaggatgcaatagaaatatcctggaagcagagaagaattagaaataacaattataaataaaaatatcaagtattggtagtaatttgctgattgctttttaaatattaatattgtccacctcaataggaaatgctgctcttattaccaaagttaacattcaacagtctttgtaaattttaacagcatcataattccatttttccatgaaattcctcttcataattcacatacaggctgttcgtacctatggacgtgagatccaagtgacagagcttctcgacaagttagacttttatgtcctgcctgtgctcaatattgatggctacatctacacctggaccaaggtatatgcaccaatactgagagaggctgatgaaattaaaaccaacgcctctctattatatttgtcctaactatgtagtccactttcagagccgattttggagaaagactcgctccacccatactggatctagctgcattggcacagaccccaacagaaattttgatgctggttggtgtggtaagtatctggctagccattttgcatgtatccattgaaaaacataagaggaaaaatatgaaaacacaacagtatctaaaataaaaaaagcaagttttatattttaaagttctaaccttctaaaagcaccaaaaaaaaaaaaaccagtttaattcatttgaccaaaacatattgagaactctgttgcgttcccagctgtgctagatgctgaaaatataaggctgaacaaaccagacataatcctactactcatggaatgtatagtctagagggggagacagctattaaataaataattatttacataaaatcgtaatgcaattaagaatgatcatagtaataattttttcatggatattagtttgtcccttacttattaattttcttgcactatattgatatcattgtgtaatactacacggagacacattggtgattccatatgcaacttcttaccaggttagcttaaaaacataccatcctaatcctgtgattaaatggatattttactatataatatatacataatagggacaactttaaggactccttgataaggactcctatgaaaacaactccctaatttgaaagtttaaaacatccccacaagaacttcactaggtgatccttgccattaacatcatatgtttttccagaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttggtaagtagcaaagtagtaggtatgacattttactattgagattttttaaattctaatcctgaaaaaaaaatcattataagaacactttctggaagtccctttattgatttttttggtagtagaattgaaaaacttattacagatttataaggaatctggagttggctaaaagaaatacaattttcacgcaggaaattgttccccacatgcgatttattgactaatcttcaaaatgacaatagttccatttcctctggcttcaccacaatgctgacttacatgatgatttcagatgcatatgagataatcaacaaagttgcttgatcacatacatatttttttttcagtcagttttgtgaagctgccctgagctgaatttgacacagatccagagcatagcagagcacagcagatgtcattaggaatttgtcacatttgggtgatatcaagtttagtcattaaatactaaaattgtttatttcactttttgattgggtgagactcaaaagtaaatcaatcaatgaacaaataatgtgaatgagtctttaccacatacagggaataaagcaaagaaatgtaagaatctctgacatcaaaaaaagctagcaatcttattgaacaatcaagacataatcacttgagcagctaaataatgagttttctcatagaaatatcacatgtcaatgaataattttttaaataagcatgtttgaacctttcaaacaatatttctttaatttatgaaacatctggctgccagaaattggcaccaataaactaaaagagcaaatataagatttaaagcatttgagttatgccaaaaaaaaaaatgtattccatttagacaatgacatggatatttggcttacctaaatgcataaatttgaagacctagtaactttaaaactgaaaattgttgttttatactttcagattcagtctttcggagaccaaataaaatatgtaatgccgtaaatattttgagaacaaatcagaaaaataacccagtctcctagaaaattgatagctaatagttggatgggcccttttctttaaaaaacaatacaatttttcaaaaagcttttcatttttccccatccatggccaaaaatatatatatatatatatacatatatatatatatacacatatatatgtgtgtgtgcgtgtgtatatatatatatatatatatatatatatatatatatatatatatgttagcaccgccaagcatttcagtttttcacttaagcttggtctgtatgtgttcccaatgggtgctcacagtattgctctcccagagatgggtgtggttggctctcatttctgtccaaaatttctggccaccagaaaagaggaggtgggggtatgtagtttgtataactcatgtaaatatatttaagttgtgccatatcagaagagaaaaagtcaaagtcataactacatactaatgagttaattaaaataaaaaaattacaaaacacattaagggtagcaataacatatatatatccagtttgcttcaatatcaactagttttagacataactactaaaagactaacactaaagaataaagtttaaagtgttcctggaagctgagctaccaaagttttcttattcaatacattttcttattggaggaataagtttaagcccttttagtgatgagacagctttgttgccactagttgtatacaataacaaccagaacctgggctactctaaaagtctccaaatcattcttaaaaaaaaaaaaaaaaaaaaaaaagacaagtaagtcctgcctttagaatattatgaataatttttgctacttcctaaggaaattttctccagtaaaagaaccaagcctcagagttagcaagtttaatgggccaattcacatgtgtgccaaatggtgtaaaaatgttccaacagaacatgagtcactgatactcttccctaagagtcacttctttgtttaaagtcaaggagaggtaatagtaaaagagatactattcaaaatcctgtcctccaaaattgttaaattctaattgccaaagaagtagagtaagtagaattctaccgaagtaaaatgttcataatctattctcaaaaggagaaaaagcacaagccacaaaataatcttatcttggatgtttgtttctacacatacaaaactaaaaagttcaaataaaaatacatgccacttttatctttaccagagtacaagacaggtaactaaaatgcaaaaatttaatttgatgtatcatactcattgatttaaaagttatttttaatttccaataattttctctattgattaagcttttctctagtatcttaaaagaaatatttaaatgccactagtaagtggcatgctacttaaggtgactgttatttgattatctgattcatttggtgtctgaatttagtttagcacgccaaagcaactttaatattttgagtagctggagatccttccaactttttcttatattgtagaattctagtttacttacttccagagcacattttgctaaaacaagctcattaactatagtgcaattacaaatatatgtatagacaaaaaagaatatgagtctctcaaaaataacagtattaacagttttacagtttttatttacaatgaggatttcaaggggaaaaaaatgtcttggtctagaaaagttaattttgcacccaaatctagtgcctccatattaattcttacatagagaaatgtgactctgctgcagaaaacaaaaggtagtaaaacattaggaacatgatttcttgcatcataccacattaaaatttaaaggaaacaatgaggacttacagcgttctgccaagtcattggtgtacaagagatttctatttttctttatacctataaaattattattttatttatagcaaaaaaatatatatgtttcaaggagaataagactagactaaaggaaattattttgtgcttatgttagcattttcagcccaaacttaggacatcctataaacagcagtcctttgatatctgagtcatgataaaaatgtatgtgccttcatttctgaatgattttacatgtagcttgcctaataattgctcatatcatgagacaaccttcagaagaaagaaaggcagagataagaatgcaaaagaccaatgaagtaaagaacaggaaaagtattatatggattgcagagaagactacaatgtttctctaagatatgtttagcagagcagtagaaagtagatggaataacaagaatatcttacacatataatgctttcccatttgcaaactgcttttactcatactatattgtttaaagcaagaatacaaagtgcactctgagcttctaatggcctcataaactgtccagtctctcagtgtagacctcttttttttttttttttttttttttgagacggagtctcgctctgtcgcccaggccggactgcggactgcagtggcgcaatctcggctcactgcaagctcgcttcccgggttcaagccattctcctgcctcagcctcccgagtagctgggactacaggcacccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagacctctttaatataaagttgccactaccgtcaaaggaagttttgagacttaaaagaaaaacaatgaatttagatttccaaaattctaaaggacaatgaaatattgaattctgtgaccttgttattgtcagagaaattaaaactgggagaaaaggctctcaaacctagccatatggctgcacttattgggcaggaagaagctcccaatctttggtgcacctcccctgcaaagatgtctacatgacactgttaataataataataatacaacttcaaagtgaaaaatgggaagccagaagaatatccagccaacaagtatcttgtccctctccacagattaacaaaatggaaagcagagcgcactacacaaaggtgccaatccagggcatgtgtcttgcaccatttctctgcattagaagcacagaatgttatgcctagaaaagtcttagaaattctctggtctgtttctcattttccagctgaggcatggaatgcttggcgaagccaacactagtagtcagggtagccctgggtctaaggctactggctcctgaggaatcttctaggctgcctcaatttccaaagacacacagacacatatttaagtggccacatgctatggtggtaccccatataactgctttgcagaataacattcatcagaaagtctttaatcccacacagtacatcataattacctctgcctctggacattaataaagatgtactctggttagctaagatgactaacttctcatggcctagtctttatgattctggcccattcttttgagagatatatattcattaacgaggaaaaagataacagtaaccagaagaagaaatatgacagactttctgaaaaattattaaatgtgaacaaaagatagaaagctacttccaaattctaacaccttccagtccagtggcaactcagtcactgcctcttaattgaagttttttttgtttgtttgtttgtttgtctgtttgtttttgagacggagtctcgctctatcacccaggctggagtgcagtggtgcaatctcggctcactgcaagctccacctcccgggttcatgccattctcctgcctcagcctcccgagtagctgggactacaggcacctgccaccacacccggctaatttttttgtatttttagtagagatggggtttcaccgtgttagccagggtggtctcgatctcctgaccttgtgatccgcctgcctcagcctcccgaagtgctgggagccaccgcgcccgtcttaattgaagttttaattaaggcattactaagatagaagtccactgctctcctcaagaatttgagtataatgcaagattataactaaagataaacgtaaaaatcagagggaagaaatattgtgattagaaggcagacagttgcagggccatgcacacacccatgcacatcactcatcacagctgtaccatgtccctgcctaatagcaagagtagcaagccacaattctgcttccaggcaggcttaggtgaacagggctttaggcacaaaacatctgctgcaggaattgtctccaactttatactctcatttaaaagacaaaaattttaaatgacaaactcagaattcatttaataaactagtcatttattcaacattatgctctttaagtgacttcttggcctgataaaattctcctaccaggcttgctcagtacatggcttatcaatcatcgaaaatttcatggccaagcctggtggctcatgcctgtaatcccagctctttgggaggccgaggcaggaggatcactatggtcaggagtttgagaccagcctggccaacatggtgaaacctcttccctactaaaaatacaaaaatttggctggatgtggtggcacacgcctgtagtcccagctcctcgggaggctgaggcatgagaatccatttgaacccaggaggcagaggttgcagtgagccaagatcatgccactgcactccagcctgggtgacagagcaagaccctgtctcaaaaaaaaaaaaaaaaaaaaaagaaagagaaagagagaaaaaaagaaagaaagaaagaaagaaaaagagaaagaaagaaatttcattgagcacctattaagtgttcattataaagtatgtttcctgccactgagaatttacaatcctactgaaatgataagacttgggtaccagaaaccatacaaaaggagaacagaattgggagtttccagttagtgcaatagtaagaattcaggaaaggaaaatagcaatgtttgctgaagctgctcagtgaagattatagagaggggatgcaatttgttctgagctttgaagtctgggcaggatttgagtggcagagaaaggaatagggtgttttaggcagagaaaagagccaacaaatgaacaatggagaaactgaaagatgaagttgaggaagaaagtagaagagggtcatcctgtatcgagtgttctccttagggaagagtcggggcaagggccaatcaatgaggtaaccaggttgtgtaggcacttgaatgccaggatgaatcctgtgtcacagtgggccctggagccagggacctggaaaataggattgcaggtccattacaggacttccagtagaatctggaattcaaacaacaaacaatttttattgtaaccatgtccaaatatttcatgggacagacttatactgaaaaattattgttcctctgaaatttaaatttaactggtcagtctgtattttttgctaagcctgaacgttctgggaataaagtgatgttttagcaacagtgacctagcagaggtgtttaaaagatagctgtaatgtcatcaacgagaaaaaggcattctcatagcacctttaaaatcagttgtctttctttttaatctttttcctaaaataaattctagtttaccataactaaatattttatatgacttccatttcaactaattttgccccccactcccactcccacccccagatgacatttggcaatgtttgggagacatctttggttgtcataactgtcgagctctactggcatctagtgagtagaggccaagggatgctgataaacatcctacaatgcacagaacagccctcccatccccaacaaattatccagcccaaaacgtcaagagtgccaaggttgagaaacttgctttaaataaatataagaacaaagtcacattcctggacaaaggctctcgcctttcacaggatcttatactttcttcacaaaactttacaatgttctgcaaattacaagtgcaagagaacctacaaatcccccattagacagtatttatttatttgggagaaactccacttccaccagaaaaataaataaataggtaaataaataaatacattctctagactttgcaatttcagctgactcacacttcacatttcccttgaatttcaaagagcttaaaaatatgtatgcagatcagccaaataaaaagtttggttttcatcagtgaaagcgttcccacactccccgtgggctctgtggaaatcggcaggcctggttctcctaagccaaactttttcctaactccttgcccttctctaatctcagggcctcctttttctcaaaacatatttgctttttcaggtctcaaatgctttctccttggttcctgcttatagaccgtaagggcttcttcttttgcaccaaaattataaaagttaagtttcttattggtcccttggtgtaatttacccattatcgcaggacagaaggaaggaaactgcagttaaggattattttgatgtttctcttatcacaaatattcacccatagggatggctaaactcagaactttcagttagaaacaaagttctacagaaaattttctttaaattgttttataccttatagttggtttggagcttttgttttcttatgctgtaataatgggtcactggaagattagaagaggcagccccctgtcatgatgctggctgtgtacaagagattggaacaagggctatgtgcacagtcacgaaaggggagtttctttatcatatattcgatgggaatgcaggtcagtggaaaagaatatcctctccttattcatctcaccaggtccttggaactcaatgcctggagaaacattacactaagcttttactttgtctcttgggctacgagctagatgtgacattttagactctctctgtcttttgctctaggaccaaggcctcattttgaggaaacagatgacaaaagagaacatgcataagatgtgaaaattcatagctaaggattaataaaggctgaccatgtttggccttgactgaaagcaaagttttctctcaggctggtttatatttagcttccttctgttctttacaattggtaaaaccagctccagcaacacttcttttgaagtattccaaggccacaaggagaagtgaaaaagagcagaggatttaaagaaagaagaacctagctcaagtcagccacttatggggctgtgtgcccttgagcaagttcttttatcctctgtgagtgttagttcttttatctgtaaaatggggataaaaatatctagctcttatcaagagctctttgtaaagcttaagtttttatgtaaatgttagttctgattttgaatccactgagaaacaatgtaagatgtccctcaaaaggcaagttttatagaaatcatcactaattggagtttcaagatatggaccgagttctctgctgtgtcgttgcttcttggttcttccatcatctgccctcatctctttttacagaaacatgaagggaaaagagttaccactctaaattgtagcaaatgcaagaattacctttctctctaccattcttagcaggggtcagtcatctgggttgattggaacattcccactgagcttgctgccccaggtggaattccattctgctagaaaattctgtgttggtgaaatatggacagataatgttgagaagataaatgagtaacatttgtgaaattatttgaactcttctaaagaaaagacccacactgattccagggatttttgttaagataattggaatttaaaatatgatattttacttgattaatgtctgttctgactttttttgtcttttggccttggaggggctaagagaaaggattcatagacttttttttttaattaatagaaataagtaaaatgcacagaagatgtcaatgtctaaatgtggcatcctatcaaccatcaataaatggtaccactgccctcccccagaagcatccccaatctccactcaggtgggttcagcctctgcaaagctcagcactctgtacctccacccaaatcttgattattcataatgcccctaagccagagtgttagactcagtcaactaatcatgtgctaggtgctgtgcaatctgctgaggatacaaaatgaatagccaacaattccttccttcaaggagctcacctggtgaggaaatagatgcaaaaacaactgattatagcatacagtgaaccctgataaaagtgtgggcccccaaaaaggagaggggctcaatgcttcctaagagagtagaggcagcttcacaaagaagataacactaaaactgaatctggaaaaacaatagcaattatccatattagtaaagagagaaagaggattccagtgaagagaaaagggtacccacagtcatggaggtcaggagaagcaggaaagggtgtacagggaagtaattcaggaaaatctacctcagaaggaacacgggaatgcacaacaaataatgtagcctgagagacaaggccggacctggtttgcaacaactgtttttgccaaaagaggtttgacatgatagagccatcgaagacgtggtgatgaggtgatcttcagaagatgagagatgaggtggatatcaaaatgagagagcaactgaggacaagagctgagaacttaggcataaactaaatgttcctccagtgtgcacctgtgacaggaataaaataacaacctttttaagctcacatcaacctcagatattgcttcagcatcaaaaaaaaaatagagcaactgttgccaaaagatgccgatgacggtgtagagagaacttggatgtcacttcacatgcccagagtgtggtttgaggaaaggacaactaaacatttttctgtggccttaatggaaatcatgtctaaattgatataataagtcaaaagagataacagatcacaagtagccccctttggttttgtctgaaaactgtattactacattgcaccagtaaatatattgagagacttgaaagacaatcaatcaacacacgagtccaatagataatgacaatgactattaaatcttctctagtcttcgtaactttatatgtttggaactaatattgaagaatcatatttctactaactaaaaataataattcaaggcttaaggaaaaattgaagtaaagcctgaagaaggcaaccagggaaggaataagaattctttaagatcagaggttctgcctttcagataaataactaactggagatttcctttgataaatggcaagataaagaaattgtagaatggtagaaaatatcatgtttacctacaaaaagaactattgcctcaccatgtttcacatctctagaagatggttttaaatctattatgagcattatgtaatgtttaactggttctggtttcaattggcagtggaacctaagggtttaaacaaagggttaaaaaaatctaaatctagtgtcttcgttacaataagattaaacaagaggagcaatatatttaggccacaacagtaaagatttcatgcagttagagaaagcatgtcttagtttatcagtttagaaataggaaaatggaaccctaaaatttgcaagtaccgacccaaaactctgagaataatgttagttccaggaagctgattgcatcatttcagtggaccagaacagaaaataatgagttacatttaataactctttttaagttttctaatttaccacctggctgataaagtattaatgctataggaattggaatccttgaagtcttacggccacgccctcatcagtttgacataagattctactaaactagtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggaatgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtggggtgcagggaactggagggcaatggttcttatgagaaggtgatgatgcttctaagaaaaaagattacacgtaagttaatacctaacaattttttttaattctgaaattcaaatgttctgcattttgaaatagaatgaatattctctaactttttagtctaaaaaatttccaagctggagctaccactcatccttggaactgccaattcctaagcattttcatgctggcactgaatgttgcattgactagccattcctatgtgcagtttctaatgctcctgccctaactcacacaaccctattgtaacttaatctggctttataaactgccacattgccaagtgttttttttttttttttttttttgctttgttttctttgcgtttttgcatgcgtgtgttttggtttgtttgcctgcaaacaggtaaacaacttctttgcacaaccataaagacttccttgtctcctgcttttctgttacaaactcttacaagacaagataaatagaggctcagagtgaatgcttggggagggtattagggaagacattcttgcacaagaattacttggatcatatcactaggttaagtagaaaaatgaaaatgggtcctgaataagcatataatacgatccaaattgttacttacatgctttgaatgccttaaaaataatgtacagggcatttgtttggcagtgtgcttttatttatttccttacttattcctgtttcttttgcagaatgccctggctaaagctactgtgaaagaacttgcctcactgcacggcaccaagtacacatatggcccgggagctacaacaatctgtgagtcttggcttcagaactgtgcaaagaaccatgtgcctaaaaagccaacgaaaggttcctggggcctttcttttctgatagtttaaagcatgtggcttttgcctcacagcaaatttttctaaaatatgtaatcagttttctgttcaaaaaaaaaaaaaggagggaaagcctggacaacatagcaaacttttctctaaaaaaaattaaaaaattagctggtcatgcacacctgtaatcccagctactcaggaggctgaagcgggagagtcacttgagcccaggagttctaggttacagtgagctataattgcaccattgcactccagcccgggtgacagagcaggaccctatctcaaaataaaaagggaggaggagaaaaatatccttttcaacccacagagacatttcctccctgtaagcatctactgagcacttactatgtgccagggccttactaggcactaagagaacaagaaagtaagaatagagagaagaaaagatgaaaagagaaaaggaaggagggagatcagggcaatctttaaagaactagcagtagggaagcagcaaaaataagcagtcttttgtgatacaggtgctaagtgctgtgacattaggatgcacaaggaaagaacacacccaaagaccaaccaaccccacagtatcagaattaacttcccaagatgatgacacaaaagttttatctgaaaggattgttgctggaggaaaatataagacagagtgttttcagccgggtgcagtggctcatgcctataatcccagcactttgggaggccgaggcaggcagatcccgagatcaggagctcgagaccagcctgcccaacatggtgaaaccccacctctactaaaaatacaaaaaattagccaggcgtggtggcgggcacctgtaatcccagctgctcgggaggctgaggcaggagaatcgtttgaacctgggaggcggaggttgcagtgatctgagatcctgccactgcactctagcctgggcgacgagagcaaaactccatctcaaaaaaaaaaagacagagtgtttttttggctaaacagacgacaaacaagtaccagggctacctgaggcacaagtcaccttcaagaggtagacaccagtccctctaattagacactcagtgtatgcaagcaagtggctagagtggtaggggctagacccaagagctgtgggtgctgcagcttagatttatctggaaggcacattccacaggcctcattttcaatttctacgtatatcttcctttgccttcaaatggtttctttctgcctgaggttggaaagaaattgaaacacacacatgacaaaagacccagtctcatcatcaagtggcctccagtgcagttggagaggctccagtcctgagttgttgggatttattttaagcctttatgcaaaatacaattttctttatttttattatttttaaaaaactgctctgaatcatatgaggcatactgttttcttaaggggtttctagcagagatagcccacctatttatatatggtgaacttggtgcatgttttattcagttcaactaggcttctttttccattacactgtaagactttggagggcagagccaacatctctcctttgttctggcatcttcagagttgagcccatagcctgctgttcagtgggggctatacaattgttgattgaaaaaacagatgagtgaataaatgaacaaatgaattaattagtacatattctatgtgttagtgacaacatgattgttattgaataaattaataacatataccttatctacaccaggccctatgctagataaacactaaaaatatgaaaatgaaggcatagccctgccctcagcttcttcaatcttatcgtttggcacagtttcagccgggtttagagttttctcctcttgccaatcatcatacggctttccttattttcctgagagatacacatcctttcacatataaagtgtagtttaccatagcatacaagcacactgggaattttgcattacagattacgtactttctgaagtattaaacacatcatttctacaaagtgaagtggtgatacgtttaataaggttggagtaattttttaaaacagcccccataacatttatgatccagtttactagaaaattggcctactcaaaatattttgcacagtgaaacatttgtaatgaaaaaagaaactggcaattttttaaagctccttcctagatttaaagttttttttcactgctgtttgcacatttcagatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 3 - DNA, 5203 bp, Artificial Sequence
  Based on Homo sapiens sequence
tggtgagcctggtgaatcccccatgatagaaccaacatttaccaaaggcagtttgctctgagccctaggcagcaccaggtgctaagaggcagcaaagcatggtgagagatggcttctgaaatctgttctgcatttggggatttgggttcctctgccagcctaaggcagagctgtccccaactgctgggagaacctggaacgggaacactgctctgagtcgccggggggactctacagcaccatggccacatcctgccttgggcccctaccctgttctagccagtcagcacagggagtttgggtcgtgctggaggagctggctgtgtgcaggcggccgagtgagctgcctgctaatggggctgggccaccccgtgctgctccctggaggctggacaaggctgggattgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtaaagcatcttgctccagccacccctcccccatttccatagcaactgcacacactccactccagagatctccaaaccctactactaagggaaggcaccgtgagggcagctagaccccagcgtattcctcactcctcccccagatagatgggcagcactcagggtaggggagacccccgaccatcccacttgtgggagcgagcaagggataccctgggaggccctcatccatctttgttctgctggggtgcagggactagggccaggtttgcctttgcccagcagggtctccagcacccatctcgggcagaggctgggggagtgactgctggtgcaagccccaaagtgcatgcggcaaaaacatggatgcagagctggtggcaagaagaggggctaagttatagagttgctgcaaagttttggcctggggaggtggggggagtgtcctagtcctcctcctggggcggctccgcctgcccagctggcccagcccctccacttgtgccaaggaatgtgccgggagaggcgggcggggcagcagagctgcggccacccggaggcagtgcacaggtctggggctgagggatacctgggctcaggaggggcagggaccccaaaattctcctgggggcacaagtgtagtcctcagagaaaagccaggcatccccctacctccttgtcccacctgatggcatctggcttctccagagattcggagtgccaagagtgttctgtgctcagttcaggcgctgtgggcgaagcacattctggtgggaaagggagtggtactcaggctgtctctgtgctggcctccaggagtcaggattcttcctgagacaaaaactggggcctgcggggctggatcactatttgaggcagcctcccggctgggaggaccccgccactctttgctgggctgaggccgccaagcccctcagtgtggggactgaatgccccaaggagaacaggggttggagttaagtggtgcaagggctggggaaggtggaccagcttccccaggcctgaaggaagcagctccaggagggagggtgccatctgcctcccacacgcacagcccatcctgcggctgaacccaggtgaaaggggcctgtggatgggggcagttatctgatcccctacctcccactctgtctctaggtcaacgtggaggtaccaggccaccatgctcagtctcaagctgccccaacttcttcaagtccaccaggtcccccgggtgaggggctccacccactgacccaccaacccccattccctagaggactgactaggggctgacgttcttctcttttagctattggggcagcccctcctgcaggcgaactcttaccctcccattccagtgtgagactcttcctctgttctctgaggaacaagcttgtggccctccatctggagtccccttccccagagcgccctgtgtgctgcgctccacccccatcccaccccaatctggctcttcggtttcctatttgttttgtgggttgtgggtactgggacctgtggtaacatcagatcagatttagtttggcttgggggccacgttgatctccagcccagcctctttgaccctgcttccagagatctcagatggagggaaagggtccgggcacagtgacgcccttcctctcccaccactaccctaggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggtgagccggacaggcgcgggagcgcggggtctgggcgtcccggagcggggcgaggggtgggacgcgggacataggggcgcgcccctcaggcctcagctgcacgcccccacctcaccgcaggctgcgccttcccctatgccgcctactccatgccggcctcctggctgcacggccacctgcaccagttctttgtgcctgccgccgcactcaactccttcctgtgcaccggcctctcctgctactcccggtgggttcccaggcccctccagtggggacggggaaggcggaggcacaggagaggacacacctcactgctctcgaacagcactggaggcatcgggaccatgtactgaggacttcctctgtcagaccctttatccccacatacagatgtggtcctttacacaggaggtcatatgccctaacggttttcttagctgcaggctgtgctgatattccatctttgcccaagtcctcttgcctttctctgacccctaccccaagcacagcgatggtgaccggccttttcctcccgcctcccagtttcctggagctggaaagccctgggctcagtaaggtcctccgcacaggagccttcgcctatccattcctgttcgacaacctcccactcttttatcgggtaaggaggcctagggcccctgcccagactcctgctttcctgtcctgaccctcaaggtgcccacttccagccctgccccctcagtccctgcctcagcccagccgcctctcttggggtccagcaccccgcctagctgtgcccgcccgctctgcgtcctcaccagatcccagacacaccccatgtttcggctcccgagtccctccccagcagccttggttttcctttgacagctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggtaaatgggtattacagccccaggatggaggcaaattataggagggacttccctgtcttcctataacgagagcatcactggaagggtcctccacctgccacttctcaggtagcaaaactagtagcatgtgtgctggggccacatgcacacatgctcattcattcctttcagtcactctgggagtcagggtttcttattctcaatttatgggggagtagcaggcccagaggatggggtgacttgcactgggaaaggtgtggctctgacctgcccatcctctccacaggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccaca

SEQ ID NO: 4 - DNA, 17940 bp, Artificial Sequence
  Based on Homo sapiens sequence
attcccatggctggccagaggaggaacgctttgtgttctcatcggaggtaagtcctgctttaagccccaggaggcttcctcctaatcctgggaaatcttgatccactggacatgctaggattctttgtttctggaaatttttagaacccagcaagtagtttggaccctggccattgtcaagtgctccaggtaccactctatgtccaactcagtcatgcttccagtcatctgcgatgctccaggcctacggacgccaccctcttccttgtcccagatattcccaccagggaactaggtctctattgggatctcatctctaagaatcaccaatcctgggtgcttccctatccctgctgtctcatagcatactcatggtatccctgcccgaaaccgatctctattttccactgaagtcttccagaggttgtaggaagttatccaaagatttggccatttagggaaagtatttcccagaaaagtaaatgccatccaaatgctggcaggcttttttgcagctctttctttctgcctcgccaccgcccccaacccccattgatttatttattcatccttaatcctctactgagtactccttgtgtgccagattctgtactaggagcaaggaacatgaggctcggtttggcatggttccacagtcacagaaatctacatccatagaggacatttcagggggctcttagcagcacccaatgcataaaactaagaaagggcagccattacttttgtgtgcaggtattcacaggtaccatatccctttttctctatccaatctccaaagagcctctacttccacctgagcagggaccatcctgagacctttctaggacattctgcagtactagccagctctaagcttgcctttggtttgcttactgtcaattttatcacccattatctcgctctatctgtccataagtcacacctactttgaaacaatgcagctctttatgaaggaagtcaacggatctgtttctaagaacatagacctatgccctaatcttatcttggtcttttctttcccatagctgcatgggaagtctgcatacagcaaagtgacctgcatgcctcaccttatggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcaggtaaggaagaggaattggcagttctaaagcaaaaactcagagctagaagtcaagggaaacataatgagaaacaatggaaatcaagtcacaatctctcaaagagcctaatcagaaattcctctgaaagggcagtgggagccagttaacataatttcccatgcccatatctttgggagattagagaccccagattaaagaagatcaagaaatacataactcagtcaccttgtgctggcaagtgccttctccttttcctgaaagggctagattaagtgatctctttatgaagtgggcaattcagatacttgcagaaaggagtctcaggcttagaattagagtgcaaatttcagcccctggaggagggtgggagagggtactgagctcattggaggcctccagtggaaaaatacaatctaagaataacaaatgcagtgattccttgtcttaaaataagtacatgcatgagcaaagtttgaaaatctttttttctgaaaggcccttctaatgtgtattataagcatgtgcaaagcttgaaaatctcttttttttagaaagcccctttaatgtgtattgtaagcacatgatcctgtgtgtgcacttagctccttcttcaggcatctacagcattcaacaaaatagaactagagaagacaattagcttgaccctggtgctgtgcttggcattttacacatattatcacatttaatcctctaacaatcgtttaaggctttctttccccaaatgaggtgtatatattccaagatggttctgggggtgcctggcaaactcttaacaagtttttaatggctgtatgtttattttttatgcacatctaaaaaatataactagcacatgatatctatgttatcacagatattattctttaagatgaaactaattcttaaaagataatcattgaaagaaacattttaagtcaataataggacaggcaaacacatgtatgacaaaggtcatgacccaaagcgtaggaacggataaagtttgagaaccactggttcacaggtgtggttttgccaatgagtctcaggggacttaagtcacctgccaaggtcacccagccagcaggtgtagaattggatttaaactcagcctgaccagcctgtggtcttcctccttcacttctctgcctcttcatacatcacagtttctaaaactgtttttaaaaatggtagatcaacaatcagaaatggtcttgttagatcagtggttctcaactgggggcgatgccccccaagaagacatttggcaatgcctggagaccactttggggcatgctggtgggatctggtaggtagaggtcaaggatactcctaaacattctataatgcacaggatggctcctccagtgaagaatgacctagccaaaatgtcaatagtgccaaggttgggagttcttgcaatagactgtgctactggtatggaaaaatgtctatgttatattaagtaaaaaatgcaagtggaaaaaaagatgttgcacagaattaaacttatttttatttttaagaaagcaatatattttaaacttgcctaagaagaaggctatattacaaatttattgttacttctggggatgagatgggcttatgacaactttcatttctgctttattaattttaatgatgtttgaggttctttttcagtgagcctgtattacatttataatgagaaaaacaaatattggtcaaacaaggctgctgtttgcatgatgcacaggaaagaactttgttactctgaggcagggagggaggctgtgcaggacggtagccctgatgtcctcaatgcctgtaaaataccacagaaggtcctcactgattattctgcccccaaggtgatgaagttgatgtttaattaatggaccgtgtgtgtattgtcctcattggagtccttagcacagccaaaatagagcatggaggggaaaaaatcctgtaggttctggcattgctcagtaaacccaactgcactctgtcactttcccaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacaggtgagcagcagagccctggaggaggcagctacacagccaatgagatgcctcccaggctcagtagagtgagtggagcaagtcaagaggagacaggagaggatgcagagcagcctcgactcagctcctgcccagtgagaactcaacacaggggttgagaccttccaacatttcaagccagaaattcccattcaagggtgaaatttcccagtttataaatgtgtgtagcataaaatccagaactcatgctcgttccgattttggctccatttgagaagtttaatttgcctccctgagcctcagtgttctgatctgaaaaaaagggggggggggtacagcaaaaataacagctaatacataatgctcacaatgtccttgttgctatcctaagtacttcaaatgtattaactcatttgatcctctccccagttccacgaggtaagtgctacctaattaccccagttaggggcacagagagattaaggggctctcctagtatcacagagctggagcatggtacagctgggatttgaacttggcattctagctccagcatccatggccttaaccaccatgctgtcctttctcattttgattgaataggctaatacattccttgtccttagaatagagtcttgcctgtagtaagtgttcaggtggcagctttagggctctcacttatcccattggactgggagtcaggcttgatgcttccactaagtatcacacaaccttggcaagattcttgtgccccggtgaaatgaaagggttggacttgggggcctcaagtccagcccgcactgcatcctgatcttctctctccatgccccatcacctagacccatccactgtggaggacaagtgtgagaaggcctgccgccccgaggaggagtgccttgccctcaacagcacctggggctgtttctgcagacaggacctcaatagttctggtgagctgctcactgggcaagtaactaccatcctgagggggcagggcaggagggagggagctttagagggtcaagataaggtataaagcagagtcaggggcatggacctgaggtcaagggaatgtgggctctccaatccatttgctgtaaagccagtgggtttgcaaggataggagggcagggttggagcaaatttccaggtcagctgctgggccgtggcctcaggaaatggttctgacatgggcaggcttgacccctgagggatgaagacactgaagatgataattctgctaatgtaggagctatgttttcatagccacagggtcttcatgtcagggacatgggcagacttctggggacaagtcactactgtctctgagcctgaatatcctcatctgtaaaatgaggataaggtaataataatacccaccatacagggctattgtgagaactaaatcagagcagtccaattgggcaggctcaggaggtgatgaatttctcgtcccaggaggtaagcaagcagagtgagatgtcccatgggtagggatgtcatagacaaacaagcactaagccctggacaggggatggatgagcctcccactgagattatttccctccatcactgaactctaacaagggcctttgatcttgcctttggcacaagcatgccttcctctgagcacactacaagtccctatggaagagagagtgttctaggcagcaggacaagaaggagcatgacacatttggaaaacggagccacagtgtgaacagggcgatgcttagatgtgcccagcagaagcaccctgggaaatgaggggtagggaacaaccaacaaccttgatctccttgaagactctttctgctcattgagtggataaggccccagagattcagtgtggttttctggggtttgggcccatcacagagtcagattttgggctttaaggaggccctccctgtacctggatgggctccaaggacagtctcagctgactgagtgagcaggtggcctgcctcaagtcttcatcagtggccagcacaatgatgagtgtccagtgggccccattgcttgcagacacatccctctgtgctctgactttcacttccatctccttctcccacaccctgctctcattttaggttcctgcgcctctgaactctgaaattccacaaatgcaccattccctctatcccatctccatgcttttgcctctcctgttcccttagcctgggatgcgttcacttgctttactgacttgcaaaactcctacccacgtttcaaatttcataccactgtgaatccttccctgacttcaccaagagactcagatagaccttcttctctgctccccctgcatctgtacatacttctgtctgtatctttatcatattgaagtataataaactgttgatatgttggtgtttacacaagaccaagaaatcctcatgggccaagtccatgccttatttacttcatgttgaatgcacctagcatttgagaaggtggttggtaaagtggctcatgcctgtaatcccaacagtttgggaggctgaggccggcagatcgcttgaggtcaggagtttgaaaccagcctggccaatatggcaaaaccccatctttataaaaatacagaaattagccaggtgtggtggctcatgcctgtaatcccatgcctgtaatcccagccttgggaggctgaggcaggagaatcacttgaatccaggaggcagaggttgcagtgaactgagattggaccactgcactccagcctgggcaacacagcaaaactctgtctaaaaaaaaaaaaaaaaaagagagacagagagagagataatgtggttggtaaatatatattgaatcaatgcattaatgaatgcaatagaaactgtcttcctattagtttactatttgtctcccctattcaactgttagctctataagagtgggaattttttcagttttgataagtgttgtagccccagtgcctggcagatagtagattctcaagaagttgtgtgttgaataaatgttgagttaaaatatgatagctctgaacttggtcagatgtgctgactcaacaaggtagcatatatctaactttgattctagtatggaatgcaagtccatcctgcctccccaaataacacaatccccaagaggaactagactaaaaaaccttagcaagcctgcacataggacacttggaaatcttgaatgaggggccccctttgccagtcccacctactgccagcctaggcatgaattccatctggatcccagggaccttctagtctacataatcttctgggtcatggagatgttaccaaagagtagggaaagtgggcttccagactcatgtccattctacttgccttcatctctgctttgcagatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggaggtaagtggctttcacaccactgctgccagaaggtatgtgttgggctgatgggacctatcatagtagctctgagatcttggacaagccacttagcttccctgagcccccagggttgtgtgagagtgcacaagttggtttacataaagagcttagtataagtctgacatgtgagtttcataaacgtaagctacaattacgataatttcaattagggatggtgggggagggatgcacagagaagcaagcttgttggttcctgactcttcccaagggtcaataatttatcgttctagttttttgcctggtttcctcattcgccttcccataaagtgtcagtaacactgaaggaagaggtcccttgacctccatgagctcagaaggtagggtggctgcatggttaagcaaattgactctggaaatcagatctggatttgagatacacctacatacacatacacataaacatctgtatggttttgtttttttgccaaagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaaggtatggcattgacccttgccctttgacccataaccctggcaatagtcacatcacacttacttcaagtgcagactatgatgtccacaccatactgccagcctcctccaggagcctccagtcattcagtcattcattccacaagtattcattgattgtatattaaagatgttcagcatgaacaaggcagacatagactattccgtggctattaaagattgttataactaggcaatgcagcaacatgaaacagtgcttactaaatgtgctagaaaacaaaaacacaggacaagttcaaagttcattcaccttgaggaacaaaggtattaaacaactaattaaaccaataattacttataagcaagatgagtacaatgtaaaagaaatgtggggtgctttgggagcagggaacaggggttccagacccctgttggtggtgggtttgatggggacagaacagcttccctgcagacgtgagatttaagcagagaccagcttttatcggataaacaggcacccccgtccccagcagaaatagcatcagatagcaatttgggcaggggcttttctctgttttgttgtgtttctgtgctgaaatggggccctgttgaatcagttccttagcatccctagacttgctaggggactttctgagatgtcaaaaatccagagtgcccgtctcattccctattgctccctgggatcacaaagcaacaggatcagaaggattagacattttctaattcagtggtttccagatggtttggtgctggggctcctggttcataaaaaatcaaaatgaaagccatttatcttgttaaaattggtgtttcactgaagactgtggaatgcagggaagagatctgttgctaaaaaatgtgaacacacagaactggttctcagccccactctgcaggtgagaagatggaggtatacactcagttattccttcagcaagggagatatgtgtaacctgtcctgcagggaggatcggtggaaatcccagagacagacttgtctgtcaagtttagtgcctagaagctaataaatgctcagtttaaacgactgattgactagttcacttaaggatccaagatgtgtgtccttgccttcgtaagtgtgttaagtaagtgcagggcttgatttatgttgttctctgaggtttccactcttgtggctttctttttctcagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacaggtaacgagcaattctggaattatcatttggccttactaacgtttacaggaaagtgttcatctcatccatccccagcagacgtgtaagttgtactacatatcataaccacaatctttgacccagaaatatcactcctgagattttagcctaaaatattaatactaaacaggtgggcagggtaaataaatgtcaatattttccatttcaatatcgttgataactttggcaacaggctgattgttcaaaaatagggaatcaatttggtagtgatggattattacacagaagtgaacactggtcaatatgaaaacaatatgataaatgttgtggggtgaaatatcattaaacatgcccggctgacaaaaacaagggaaaaatgcatttctatagatcatgatttaaattatagtaataatcctagctaatatttgtcattgagctatggcacattagctatgtgccaagcaatatgtggattatctgattaaatgctcacatcagtctcataaagtgtatattactgtctccactttacagataagaaaagtaaggttcagtaaggatgagtaacctgcccataatcacttagctagaacgtgggtcaggctacagtataaaaccagtctgtttcactccagagactgtgccctcaaataatttaagccatgtgcgcttatggataacatcttggaggaaacagaggaacagaaaaagtccacgttatcatgatggagggaacccgagggactctttaattttctccactgctgtttttagaagttacacctttgcccctgtcaccctcccagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagcctgtgagtgtctctttgaactgaactcttcagagcctggcatggagcctggtacctgataggctttccatatatatttattggaattataaacgcagggagggtgggagggaggggaaagggagggacaggaagagaagggaaaggggaaggggaaagagaacgggaagggaagggaaggatggacagaagggaagggaatgggaaggtgaaggggaagaggaaagggaaagggaagattagggaaggggacgaggaaggagaaggagggagggaagggaagggaggggaaagggaagagagagggagaaaggaatacaggagggatggagaaaggaatacaggagtgatggaggaggaaaggagggacagggaaggagagaaggaaggaagcaggatgaagagacggaacgagataggtaggtgtatggatgggagggagggaaaaacgaacaataaatagatagactctagatctcctaaaggcccatatctaagcaatttttgtgtccccaggaggcagatttgataaagaaatctgtctactagattccattggcatcttttaaatgattataatcatagatgacttttttagtgcttgcactttgtcaagcactatgctaaaacttctgcatacattttttaatgtaagtctcagaacaaccctgtaagtagattattttgcctactccactgtgaggttcagagaagtccttgcccacagggccacacacaattagaaaatatcagagccagggtgtgccccagccgagaggtggctccagtgcccctgctcttgcctgcatttggaactgcctgtgaatagttggcattttccgagtgcttactttgtgcccatgtgttgcagacacatctcattttcatcttcacaaccaggtaggtattatttagttattgtagaaaggcaaagtcattggccccaaattatatagctaaaagaaagtctctacttgatgagattcaaacccagatttgtttggcatgacagtgataattttctagattgagataaccacagcatcggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtaagtggccaaatcccagtgacaagaccagctggctgagtgttgacagttaaccacagatgcctggggtcaccaactcaacttctcagggctcttgtaccacctcagtctgacccttactgaaaaacctattctttgagatgctttgggtaataatgacaatattgtcatttggacctcctgtgtgcttagagaccaggctaagctcttgcatccatcaattcacttaatcctcccatgcctatgtccattttacaggtgagaaactaagactcagagagattaagtgactcgcccaagatccccctactcatgagtggctagagttaggattgaacccagctcagtctgattccaaaacatgtggccttttccttattccacctgcttccaggtccccataattcagttccttatgggtgaggcgtaagtcctaaatcccgtctaaatgcaactttgttttctggtgaatgactgttttccaaaattcatttacagtattctggagtataatataggggaggctttccaatgactcctcatattttcatccatcctactcatgggtttacagtagtgtttagttagtgtttttatttccaccaggatggagaagtgaaagaatgaaagccttttttttcccctaaaggaattaagatgcagtaatgttggtaataataatactttctttgtgcctggcactttgtcaaatgcctttatatgcatgatcactttgaaggctcacagcaggtgagggaggtaagcattatcaccatttccattctccagagcaaatggaggctgtctcatgaagtaggctctgccctgagttttcctaccatttcactgagctctcaacttgaagcctcaggtggcatcacagggtaacttggtggaggttaggaacttccacttttgaatcagacatactggggtttgaatcccagctctgctactgactggcaaggtcaacttggcaagtcccttaacatcactgagctccagtcttctcatctgtcaaatggggatgagaatactttcctcacaaatctgttaggaggattaagtctaagatgcacgcaaagtgtctagaaaggtgcctgtgccagattctagatgcccccacaatgtggccacaaacttgctggtggttgcgatggccaggtctaggaggatgtgaagcagttatggccacagtgttgcagtcactggagcatgactgaggaaacccaccccttctgttcttgttcacaggtgcacagtctcccggtgtcatgaatggaacccctagcactgcaggtacatcattttctcatgcctttcccacagctttcccaactctcctttctcttttcaattctgccccttttatggcccagaccctatgctagggacactgacattaatcagacctaagattggcctttgagatgcccacagtatagtggaggaggtagtcctttaacaagaaatatatactgagtgcccactgtgtgccaggccttcttctaggcactgaagatgtgatggcaaacaaaacagcccaggtgcctaccctcatagagcttatgcaccagtgtggaaagtagaaaataaaaaagtaaacatggtactttagaaataaaagaaagtgatgtgatagataatgccttaaaaaaaaaagaaattcatttctttttttttcaaactcaagaacttttttttttttttaattcattttactttaagttctgggatacatgagcagaacgtgcaggtttgttacataggtatatatgtgccatggtggtttgctgcacccaccaacctgtcatctaggttttaagtcccgcatgcattaggtatttgtcctaatgctctccctccccttgccccccatcccctggaaggccctggtgtgtgatgttcccctccctgtgtccatgtgttctcattgtatagacattcatttctgtcacacataaatgaagcttagaggcaagctgtccaaggctagcggggcagcaccataaagctgtcaaagacccaggctccttccaactcatgcctccaccatctttgaggtgtggccatcatcttcatgttccaagatggcagccagagctccaacctttgtatccaggcagcaggatggagggaacaaggaagaagccaatgagtgttaaaagacattcccgaaagctggcaccttatatctccacttacatctcattggccagtgcttggtcacatgccacacattgctgtgaagaaagctaggaaatgtaatctttactctgggtgggccatgtgcctaaccaatgtttgatggctttattagcaaggtaggaaggaagaatgactatcagaatggataagtggtcagaaaaactttcagagtaagtgatgttgaagccaattgagaaaaatgagtcggaggtgcaaatgttaggggaatgagccccatatgcatgggaacatcaataattcattgcacaagtgagacagacacttgagcaaataaatgacaagcaagtagatagtacagaaagagtacataaaaggctaaataactgtattggataaggtctggaaagaatttcaccaggtagtaacatctgaatggggttttgatgaatgacttggagctaaacaagctaactaataaaagaaatatcacactcacacacacacacgcagagagagagagagagacagagagacagagagagagagagaacatttttacatttttttacatatttatagggtactagaaatatgtcttggacaaaatggaaagcacatactattaagatttgctttcccacaaaatgacttatattggtgaacccaaacatgaaaaggttctttccatcctcaaagcccaaacttagatggcagtttttaaatttcccaaataagtccaagatggactctctatgttccgtgctagcattcagaaaatgctaagaaaagtcacgctcattgagaggagtggttagagctcattctaaaagcagcttaggccaggtgcggtggctcatgcttgtaatcccagcactttgggaggccaagacaggcagaccacctgacgtcaggagttcgagaccagcctgaccaacatggagaaaccctgactctactaaaaatacaaaattagatgggcatggtggtgcatgcctgtaatcccagctacttgggaggctgaagcaggagaatcacttgaacccgggaggaggaggtttcggtgagctgagattgcaccattgcattccagcctgggcaacaaaagcaaaactccatcaaaaaaaaaaaaagcagcttgaagtcaagaacctcaagtctcattcctttctgccagtccttctggttagcccagtgcctggaacagtgtggtttcccagtagagtttgccaaattgactaatttctagaatgggtggtagattttggacgcttctggacaaggaggggatcagtctgatgttgagacagcctacccactacaagagggcacttgtggttttcattgtctgctatcacaatcatctttgatgttttagaattaattgaacatcaacctgtttttataattataactttttgtcatgtactgttctgaaatttatgatatttctctcctcacttctaggacatcagccagttactttgaaattggggtaatggggagattttacaatttggtagtatggcaggaaggctcacatatttctcctaggccctctgatacaagaccattatcatctgggatccacgtccttcactgaaactgagtacacagtgatgtgccaaagagatacaatcccagcagaactagatcttagagtctagcttttaaaaccaacatttatatagtgtttaccatgtgccaggcaatggtctcaatgcttaatatgaactcactcatttaagccttacaaaaatccagtgaagtcacagctgctattaatatttctctttggcatacaggaaaatacaggcagagaggtttaataacttttctgggactgcccagctaggtgtagagctgagattctaagctaagtaatcaggcatcagaggcagtgctttttaacctctgtgtctttctgccccttcagtattagtcagcataaataatgctagctgctgtaacaaacagtccccagtcttctgtgtctttagacgacagtattgtttcccactaaatcactgggggaggggatgcagttctgctccatgtagtcgttaggagctcaggcttctactaccttctggtaacttctggtaactccactatcccctgcaagtcctatcttggatcctctgcatctgctccctagatggttgatgagagagcaacaggatatataggaggctttaaggatcagacctagaaatggcacagatgacttctatgcacattttattgaccagattcggtcacatggccccacctagttgcaaaggacactgggaaaaattgcattcctgtgtgtccagaggaaaatgaaaaaaatggttggtgattagattgcctctaccatgtgagtcccagagactataactaggccagatatcaaagatgctttgcctttctcatccttgtgttgtgaaagacaaagaggccaacttatgtttgctcctgactcccaaagcccaacacttgacagtcatatttcttgtatttcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcacccgacacagatgcagcaaatagggcatcacacatacacaggcattaatactcacgggcatatagatgctgacatgtgtacactgacttacgcccttcccacagctacagataaggcctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatttttgcatcgcttttgttttctttttatgtctctgaagccagcttttcctgttcactcatcccttgattaaatatggacattctagcttca

SEQ ID NO: 5 - DNA, 5937 bp, Artificial Sequence
  Based on Homo sapiens sequence
acaccttctgaggcagcggcatggcttccctctggctcctctcctgcttctcccttgtgggggccgcctttggtgagtgctggtgcccgaggggtctgtcctgagggagccctgagcctggctgagagggggatctgagtcccctgctctgccccctggggcctcatccccagcacaggtaacctgagggctcaggagagggtgcattctggggctttctgagcccacacaacctgctccaggagtgggaaggacgatgctggtctctgccatggtctgaggctccagaagtggctggggtgggggtgccttgtgcagggtaaggtgtggccccaggagacctcccaaggcctccaccggggtttttattgtgctgggtacttgtcaagcattttcttcctttctttcttttttttttttcgagacagaatttcactcctattgccgaggctggagtgcaatggtgcaatctccacttactgcaacctccatctcctgggttcaaatgatcttcctgcctcagcttcccgagcagctgggactacaggcatggaccaccaaccctggctaatttttagtagagacgggctttcaccacgttggccaggctggtcttgaactcctgacctcaggtgatgcccccgcctcggcctcccaaagtgctgggattacaggcatgagctactgtgcccagccgtgttttctattttttaaaagagaaatagtaaaagaaaatacagaaaagaatatgacatccttgtatctactgtcagaattcagcaaatctttttgcacatttgcttcagatatttctaaaacagattgtactcaggcttcccttttctccctccttccctctctggaatgtgagcttgattctgaactttctatgaataattgcagtgtgagcttatacaattgtactacatatttttatacatctatacataaggtttcaaaaaggttacatcaatggaacggtattctatcctgtttttggttttggttttggttttggttttgagacagggtctcactctgtcacccaggctggagtgcagtagtgtgagtttgcagcctcaaactcaagggctcgagtgatcctcccactatagcctcccgagtagctggcgctacaggcacgctaagtttaaaaacttgttttgttttgtagagatggaggttttttttgttatttttttttcttttctttgagacagagtttcactcttgtcacccaggctggagtgcagtggcgtgatcttggctcactgcaacctccgcctcctgggttcaagcatttctcctgcctcagcctactgagtagctgggattacaggcatgcatcaccacacctggctaatttttgtatttttaatagagatggggtttcaccatattggtcaggctggtcttgaactcctaacctccagtgatccgcccacctcagcctcccaaagtgatgggattacaggcgtgagcccccatgcccgacctggggtcttattatgttgtccaggctggtctcgaaatcctgtgctcgagtgatctgctcacctcaacctcccagggtgctggattacaggtgtgagccactgtgcctggctgatgtaactaatactccattctacctccattctacaacaatgtgctttttccctactcaaatcttctcacttcctgcatgttgacgtggagtttcagctcattcacctgcatttttataatgcgtgctctgttgtgtgagtatgccaccatctagttctcttatttatttatttatttttttagatggagtttcacacttgtcgccctggctggagtgcagtggcatgatttcggctcactgcaacctccacctcccaggttcaagcatttctcctgcctcagcctcctgagtagctggaactacaggcatgagccaccaccccagctaatttttgtatttttagtagagacagggtttcatcatattggccaggctggtcttgaactcctgaccttgtgatccacctgcctcggccttccaacgtgctctttctcatttttttgctattacaataccagtttttgatgctctgaaacgtcagggaggcaccttgcctgcctgtgttcctgtgggcaggagacgcaggggctgccttgtaagcaggcgaatatgaccccagaaggggacagctggtctgagggacgcgggtgtgctcaaatgtaaagcccagtttgttgggttggcccgcgcacaggagtcgagaatctggtcctgacatagcagaggcatggtgggcgtgtgtggaacacctgactattttcattgttttgttttctgcttccaatgtgccattttatggtgtggaagtaaagtccagctgtgtttgttttgattttttcttgagatggagtttggctctgtcacccaggctggagtgcagtggcacgatctcagcttactgcaacctctgtcccccaggttcaagcgattctcctgcctcagcctcccaagtagctgggattgtaggcctgtgccaccatgcccggctaatttttgtatttttagtagagatggggttttactatgttggccaggctggtcttaaattcccaacctcaggtgatccaccccgcttggcctctcaaagtgttaggattacaggcgtgagccactgtgctggccaaagtccagttttattaaataagaaaccaagaccggatatatgggggctcatgcctgtgatctcagcatgttgggagatcaaggcaataggattgcttcagcccgggaatttgaggttgcaaggctgggcacggtggctcacgcctgtaatcccagcactttgggaggccgaggcgggtggatcacaaggtcaggagatcgagaccatcctggctaacacggtgaaaccccgtctctactaaaaatacaaaaattagctgggcttggtggcgggcacctgtagtcccagctactcgggaggctgaggcaggagaatggcgtgaacccaggaggcggagcttgcagtgagccaagattgtgccactgtactccagcctgggcaacagagcaagactgtctcaaaaagaaaaaaaaaaaaaaaaaaaaaaggaatttgaggttgcagtgggccatgatgacaccacggcactccagccagggtgacagagcaagaccctaactggaaaaaaaaaaaagagaaacccaaactttacacaatgtttcctgaaattgtggaattcaacctgcccacccagggtccacggtgccatttcactctcccgtctgcaaattgtcagagccccagattcctggtggacttggggttatcagattttcttcccacttcccctctcgccaccagtctaacaaaggcacgtgggccagtggagctcacgtggttctgctgccctttttatagctgaggacaccaaggcctgagtgctgccctgcccggtctagggtcacacggcaaggaaagtgtgtcctcgaggctgagcccaggcagtcttacagcccggcctgttttctgcttcttcaggctggacaggccccaggtaggaggagacatgacgctctgcatcctggaaggatgactggagccagcaggccgagagttgggaacgtttgagcctagagacttggggaccagggaggcggaggcggcatgtgccagggaggtcctgagctggcttcagtggactggggtagaaccgggagagctgcacgcaggcaggtgaggcccaggtgggtttggggcctcagcccttattcaccccactcccccccaggctgcggggtccccgccatccaccctgtgctcagcggcctgtccaggatcgtgaatggggaggacgccgtccccggctcctggccctggcaggtgtccctgcaggtgagggggttctgcaaggtggggggcaccctgggtaggggccaggctgggggtgcccccgggtgggaggtgctgaccctccccatcttgctcacaggacaaaaccggcttccacttctgcgggggctccctcatcagcgaggactgggtggtcaccgctgcccactgcggggtcaggtgaggaccgggcagccttgggctccgcttccagcaccggtcgggtgggaggggagcagggcatgttctctcacccacaacgctctgcccaggacctccgacgtggtcgtggctggggagtttgaccagggctctgacgaggagaacatccaggtcctgaagatcgccaaggtacccaggccccgtgcagcagagggcagggccgtgggcacggggggagacccctcggctgcttcagggacaggcgcccagtggggccgggccggcctcgagattcccattccggccctggggatggactgctccttaacgggcaccagggaaggagtctgtcctcgaagcctgcaggtcctgcctcctcccagggcctcaccccggcactctggcccccacccccaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacggtgaggggccgcggggctgcctctggggtctgggctgcctggccgtggagtccccccgtgaccgtttggctctaaattccaacacgctcctaactgcccgttcgttattgaaaatcttctgaatttaaaatcccccaaatgcaaataaaatccaggtcggatcatgaggagcctgcacagggagcttctgagcagcgcccggccgggtgagccctgccctggctgacctgcctggagtcgcagcgtggggctcccacccgggcagggccgaggcccccttgtcccacaggcgcttctgaggctccaggggccgtacccaacatcgtggtgatggtgcagggtagggcaggcgtgtcggccccgggtctctccctccactcttggctgagtgagcccaggggccctgaccctcctcctgtcctgcagccaacaagacccctgacaagctgcagcaggcagccctgcccctcctgtccaatgccgaatgcaagaagtcctggggcaggaggatcaccgacgtgatgatctgtgccggggccagtggcgtctcctcctgcatggtgaggctggccctgcccaggccctggccaggcgagcggggtgcaggggaggtctgggctttccacccctctctgctctcatctactaaccccactccttcctgggtgtcagagtcgccttgttgcaaaattccatggccaatgtcagagccaatggctcttggagttgtgcagtgcacaatctggaccgtggatcccagcaggacagcgggctccagcagccctccctccctcacacggaccccttggccagccccaccatgctcttcctcctattggtcaaaccagctttactgagctgccattaaagggtcccattccagggctggctcaggcttccaggggcatgaaccacataagcagctactagggtctttcataacccacgcaacagcacatgctgagcctttgctgtgtgtggggtcctggactggactctgggaacaatgtccagtggcccctgggaccagtctgtctcggctgccagatccaagcccccttctccctctcccacagggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacaca

SEQ ID NO: 6 - DNA, 1431 bp, Artificial Sequence
  Based on Homo sapiens sequence
agccctccaggacaggctgcatcagaagaggccatcaagcaggtctgttccaagggcctttgcgtcaggtgggctcaggattccagggtggctggaccccaggccccagctctgcagcagggaggacgtggctgggctcgtgaagcatgtgggggtgagcccaggggccccaaggcagggcacctggccttcagcctgcctcagccctgcctgtctcccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcagggtgagccaactgcccattgctgcccctggccgcccccagccaccccctgctcctggcgctcccacccagcatgggcagaagggggcaggaggctgccacccagcagggggtcaggtgcacttttttaaaaagaagttctcttggtcacgtcctaaaagtgaccagctccctgtggcccagtcagaatctcagcctgaggacggtgttggcttcggcagccccgagatacatcagagggtgggcacgctcctccctccactcgcccctcaaacaaatgccccgcagcccatttctccaccctcatttgatgaccgcagattcaagtgttttgttaagtaaagtcctgggtgacctggggtcacagggtgccccacgctgcctgcctctgggcgaacaccccatcacgcccggaggagggcgtggctgcctgcctgagtgggccagacccctgtcgccaggcctcacggcagctccatagtcaggagatggggaagatgctggggacaggccctggggagaagtactgggatcacctgttcaggctcccactgtgacgctgccccggggcgggggaaggaggtgggacatgtgggcgttggggcctgtaggtccacacccagtgtgggtgaccctccctctaacctgggtccagcccggctggagatgggtgggagtgcgacctagggctggcgggcaggcgggcactgtgtctccctgactgtgtcctcctgtgtccctctgcctcgccgctgttccggaacctgctctgcgcggcacgtcctggcagtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 7 - DNA, 210000 bp, Artificial Sequence
  Based on Homo sapiens sequence
  misc_feature (1091)..(1709): n is a, c, g, or t
  misc_feature (2823)..(3441): n is a, c, g, or t
  misc_feature (5590)..(5590): n is a, c, g, or t
  misc_feature (5783)..(6401): n is a, c, g, or t
  misc_feature (8107)..(8725): n is a, c, g, or t
  misc_feature (10955)..(11573): n is a, c, g, or t
  misc_feature (12121)..(12121): n is a, c, g, or t
  misc_feature (15296)..(15914): n is a, c, g, or t
  misc_feature (18647)..(18647): n is a, c, g, or t
  misc_feature (19291)..(19909): n is a, c, g, or t
  misc_feature (27529)..(28147): n is a, c, g, or t
  misc_feature (69491)..(70109): n is a, c, g, or t
  misc_feature (109096)..(109713): n is a, c, g, or t
atgtcttttctcattttgggcatctgtgtccatatggagtcatgagatagaaatccagccctttggagctgaaagtttggagcagtaacttgtttcatatcagaaacagagatgacgggatagattccctgatcaatgctatttaaattctcccaaagagtggtctctaagctctttcaaatctgaggctttctcaatcatggtgatttcttcaacacctagtctggtggggggcatatagtaggtgctcagtaaatgcttgttgaatgagtgaatgaaagagtgaggagtgagcagatgcaggagttaatgagtgaataaatgataaatgagagttcgtgaggctccaaagagtggtacttttgtgacactcaagactcaagtcaagtggaaatgtgagtagacaggctgtttgtctagtgactccaggagccagaagcgttcttggtctactctgaaatcatgtaggcacctgtcagggtagggggaggccagcgtgtagtcctgcacagctgaactgctgcctgccactgactcacttgccttttgtcaaacaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccaaaatccaggcttaagctagtcagctccactctatttgggaaacacaagccccaggaaggagaaaaaccgagatgttcccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaagaggtcagcataaatccatcaactgtttgctgagcctctgcatgtgggttacacccgtgtttcataaacaacgtgtagacatcatcagggttacttcccacactttattaaattggaaatggcaacaggaaacgggaaaacaggagagggactatattgctatttagttcctcggcacataagaaagtgatttagagggaactgggaggatttctgaccctgctaatttgcattctgggatctgccaactttttgcccatgtcatcactgatagtgggtcagtgttctaaaatactaagagggaagattcatgagtcaaattgcctgagtacatacaagtcatggtgcagccactcactagctatgcgccttgggcaaatgatgaacttttctactgtgcctcagtttcctcgtctagaatattagtatctgtcctgtagaattatttttggaatcaagtgagctagtacatagaaagcacttttaatactccctgggccttagcaagctgaactatggtgctataataaagggaaaggtatgaatacattgaagatgagtagactaggactcaaatctgaactcccatacttactactgggagtacaacttgcagtagatgaggagagatctagcaattagacgatttttggggtcatcagtatatggatggtatataaagcaatgagattagaggcaagaaaggaagtgaatggggctgggcacagtggctcatgcctgtaatcccagcattttgggaggccgaagtgggtggatcacctgaggccagggattcgagaccagcctgactaatatggtaaaaccttgtctctactaaaaatacaaaaaatcagccaggcgtggtggcggacgcctgtagccccagctactcaggaggctgaggcaggagaatggcatgaacccaggaggcggagcttgcagtgagccgagatcgcaccactgcactctagcctgggcgacagagtgagattctgtctaaaataataaataaataaataaataaataaataacaactcataagagggactgaaactcaaacctgctggccatccctttccagcacatggagctcagctgccgagtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtgttgtgagcccctaaaaaggacagaaattgtgcactcagggagctcggattttaagacagtagcttgccgatgctcccagctgaataaagcccttccttctacaattcagtgtgtgagaggttttgtctgtggctcatcctgctacaacaacaagtttcacctaatttgtcatgatcatttaattaatttaatttatttaatttatttaactggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttcttttacctccctgaatatgcacatggtttactatggcacacctatgccaattgcaatgcccattcctgaataaacattgttttcttttagaaagtctccctgtttgttatttagattgaaaaaacttgcaaccattagtatatttctttccttgagaggaaagaaaagtgggagctcaaagttaatcattcttatctgacataaatgttcttctgagcatataaaatcgttcctttatggcctcacatcattcctaatctctcttctcatacttttgcctataattttcatctaagtctatttcttctttatctttgcaagagaaatagctaattgatttgttttaaaaaaaatatatcatttggagtcacataaatgttcagccacgacaattgttttatgatgtatctttgattaaattcatggaaccagcattaattcctacatttatttccctttcttgccttctagcagcctactctaaaagccaccttcgtctaccacaggctcagccataaagcaagtctcaatgattcaaaagaattaaactcataccaaccatactctcagaccacagtggactaaaattagaaatcaacaccaagaagatctctcaaaaccacacaattacatggaaattaaatgacctgctcctgaatgacttttgggtaaacaatgaaattaaggcagagatcacaaattatttgaaataagtgaaaacagagacataacataccaaaatctctgagatgcagcaaaagcagtggtaagaagaatgtttagagtgctaaatgcctacctcaaaaagttagaaagatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcgttatttgaaaggataaatgagattaatagaccactagctagattaaaaaagaaagagagacgatccaaataagcacaatcagaaatgatgaaggtgacattataactgattccacagaaatataaaatatcttcagagactattatgaacacttctaggcacacaaactagaanatctagaggaaatgaataagttcctggaaactcacaatttcccaagattcaattaaggaagaaactgaaaccctgaacaggaccaatatcaagatctgaaattggaagagtaaataaaaaccctaccacccaataaaggccctgaaaagatggtttacagccaaattctataaaagtaccaagaagagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactctgagaagcttcaagacgaaaactccaccttgagaaatgaagataccatttttaagaagaagatagcattttaaactaaaaactagttaaattaaatggagactataaaacaaacaaaaaaataagctacagtttagaaagtggctgaaaatttttacaattaaaaatcagaacttcttgtaaattttactaaaagcagatcattacttcaagaaaactttgttgctttaacataagggaccaaatttttaggtttgtattggtgtatttttaatatcaaaactcaaaccttagaaaggcttataaataattcccttttaaatatagtcaacttgatcacatacaaaatttcttttgtaaatttatccttttcagaccttttacaacttacacagactttcgtaactttcatggcatgcttataacttttttttgttctatactttcttatttttaaataaccagtcactttattttaggaaaaaacatttaccaggcaagattttttaatgtaaagttattttcttttcttaaatctttcttaccagaaatatatctttattcccataactttctttatatctctttctatttactggattctttttgtttatattttctttctaaatccatattttgacacaacttttaataaccttttaatttaaaaaaattatttttaaatgaagtacatattttgtcttataattttttaattaaaaacagttcttacttttttggtacattttacataaagaattatatgtagaaatcagaatgctcaactcttattaatcttaatttttagtgaaaatctagaaagaaattttaaactatcacatacaaatattttatagatgaaatccttttttagttttataaacatgtttcaacataacataattttagtgtgtattaagaggcccaatgatatttagtcttttataaaatttaagaagcacataatttggttcattccatttataactttttgtattctgattattttgcaacctgatgttgtgaacaagtcattaaaattatttgctgtgatagttttactaattttataatgataataatgaattttaaaaaacaatctcaattgtattcaaactaatgtattcattcaatacaatttcaatcaaaagttcaatgacatttctgtttgtgatggaaaatgaggaaagagttctaaaattcccacaagagaataagcaagtgtatgtttctgacatagttttgaaaatggacgctagtgagtacattaaacatgtaataaagtgacaacaattaaaacaatgcagcatgggcacaagaatggaaagatcaaaggcactaagggatggccagaagcagaaaattcatttctatgtatgattttaatgtgtgcaaaaggaaacctcaaaaatcaacataagaaatgttgtttggtttaaggaatagcttaggaaaaaatgggaaaagggtaggaaaaaagaataaagcaatgcttacattacaccatgttataataattgtactaggttataattatgagtcataatagtgtttcatttttatttcatttcctgaacatttagattgtttgcagtgtaagtttgtttatttacagacacagtcttgatccatccccaaggctggagtgcagtggctcgtcaaaggctatcaacccccgcctcccaggttctagcaattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcctatctcagaagttcaattttaatgtgtctcacagcatagcatgtgcagttcatactacattgccttctgttctttcactttcttcccttgagaaggtacatctttttgcttggctggaatgttgactttctccttcaacttctttgttagctcctataacttcttcctctcattctaacagctattgaggcctgacactaaaaatgtttgtctcaaagacctagaaaagcaatgtttctttttttccagtataacttgattctgtacttagcttttcttcatgtgtctacattgttccatgtaaccagggaatttctcatgcttttactaagagccatatatccccctgcttaaagtaatacttttcttgtttatgttccacagcgtacagtcatagccttggatatacattctgaatacatacaagtcctttttcatcaggttgtctaaacaggcttcccatgaggtgtaccattcacataaaaggaggtttttcattgcctttttaagaactggcctaagaaacaaatattttatattttatcaagataatttcctgtgttgcctttactaaatttttttattacttttaaaaaatggagactttaagggttaaagtttttttaatatctatataactttctgtattgcttttaagatctataattatcactctaattgaataaatgactatcacacagtgccctgtgatactgttttgatcaggtattttaaaacttttggcatctttgatggacttccccagcatcaaaatgctaaattaaatctttttgacataaaattaactttgagattttccagtcaggcccctagaaagcctcaaaggacttctctctcatcttgtagagatattaaataattaggcttatttggtaaattatatgggaaatatcaaatgctaagtgatactagatcttctttcagttacatttatggatatgttattggtatatatgttctaaaatggtaataaaactcttaaaatcttctatgttatcagtcataattttggttattatattgtaggccacaaaataactaaatttccttgtaaatttctggttatggggaacttttatcctattttcaactatggtagttttaaatttttgtcatttacagttattttaaatttttctctaaagttgtctgcaattagattcattacaaagactttgacaaatactcttaaatacaagtttcaaaaaactttaagatcaatgtggtttttttcccccaagatggcagattagaggcattgttagcatgcctcttgtattagtcccttttgatgctgctgataaagacatacctgagactgggtaatttataaagaaaaagaggtttaatagactcacagttccccatggctggggaggcttcacaatcatggcagaagatgaaggcatgtcttacatggcggcaggcaagagacagcatgtgcaggggaactctcctttgtaaaaccatcagatctcataagacttattcactatcatgagaacagtatgggaaaaatccacccccatgattcaattatttgccactgggttcttcccacaacacatgggaattatgggagctacaattcaagatgagatctgggcggagatgaagccaaaccatatcacctctcatacttggaaagacaaaatagtgtgtagagactcacgctataattttttttccaagaaacaccacaggcatttaaccagaaaactgaaagaaaccacagactctttgaaagaagtggtggcagcagcctacaccataagccaggtggaaaactgtgagtcctcagagtgtggcagtgggagagactgcctctgtgacacacagtcccgctagggaacctgataatataggccatgggggatggccttggccccacccagcactggagctgagtggtggggaatgttgagaaggagcagcatcggacatgctttgcgtgcactcctagactccagtggggatggagagaagacattcctgcctgtacttcacagggagccttgcagaagtcagccagccaactcaggtggcagtcacaggttgagagaaggtctcaactgtgattctcggcataatcttgagtggggatgagctcccttggccagaactaaggggcaagtgggggtactgtagtcgcaagtacagaagctgggcacccctgctttggggtggaccaggaggggcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttggcacatagagggtgctcaagaaatacttgatgaattaatgaaattttatatgttaagtttattaatctataaagtagtcctttggtctttgaagtttaaaaggagcaaaatgtcaattactcatttgtcttttttttagatttaacaaattgttacatacttttcatgaccattacattgtctttgtaatccatgatgtaaatacttcatcttagagataacatggtgtttttggtgtatttatttctgttacagtatggaaaatggtaataatggttatcataaagatcatgtatatggtattcacaatcctgttatgacaaggtaaagcaaagtctggaagtgcatgcccgccctatgataaaccgtctcatctcctatagatcagcactgaattttctgcatgctgctgatgccttcacttctctctgtatgatactttatcaatgctagtctccaatcatgctctacatagtgttccatgatgccatgagtttaaatgttcagtcgatttctaaacaatggaattattcagcaactaanatttggtgtcatcttaaaatgctatgtatggctgtagatcattacagattaaatgcatgcataccttgcatttagaatttctctgcaccaaataacctgagtagttacaggtgtcaaagcttttccttccttccttctttctttccttccttccttccttccttctttccttccttccttccttttttccttccttccaataaattaactgtaaccaaccagaaaaagaacctcaattattcctccgaaatctttatgaatttacattctctagaattaaggagcttctgtggttctggatatatcatatgtcaggtaactctgagctttgcttgccagaggtcggtcctcttctgaggctctactaagaattcagacccacacgtcagccagggacctatctgcttataagaggtggagacatagtgtgcagggcagcagggcagcagtgggctgtcctcttcagtgggcgtgatccttcccacgcccatacagctggcccgccagtgctcccccgagcccgctccccacagtgatgtctcagatgcaaaagggtgagtctaacgttggtgcatgggggagatccaccttagaaggcccacgctccacatgggaggcatccagttaaaagtgcccacattcaggtaagcccacagctttggcttcacaccaggttatttatatttagagcctcccaggccagaagctgcttaccagtcaggcacatccttatcttaagcaatattacctagtaacagttgatgctccaccttggtcagatttcaagatgaacagaaccagaaagtcattaaaatttgtcctttcaagaggtaaatggcttcctgaacttaaaactttgaacattgtaaaaaaatcagaacttttcattatgattttccatttaggggaagagaagttaactgagtgcattccagctgctataatgaaatgccttaaactgggtagcttataaacatcagggtttatttctcacagttctggaggctggaatacaagatcaaggtgccatcagattcggtgtccggtgaaggaccactttctcataggtggcgttgtcttgccaaatcctcacatggtggaaagggcaagctggctccttggggtctattctctaagggcgttaatgagagactaatgagggctttgccttcatgacctaaagcgtcaccgtgattatgacgtcaatgtatgaattttaagagtgcacaaacattcagatcagagaagaaatggtgataattaaaaaaatcaagttcttggccaagcgcggtggctcatgcctgtaatcccagcacattgggaagccgaggcgggtggatcacgaggtcaggagatcaagaccatcctggctaacacggtgaaaccttgtctctactaaaaatacaaaaaattagccaggtatggtggcacacgcctgtagtccctgctacttgggaggctgaggcaggagaatcacttgaacccgggaggcagaggttgcagtgagctgagatcgtgccactgcattccagcctgggtgacagagggagactctgtctctaaataaataaataaagtcatgaaatggcaaattgacttcatctcatctgatacttccagtatgcaaggcttggtggctagagtgctgtgttgtgacagagttgaagatcgatttaagtatcaattagccaggtgtgctctggggagagtagacagtacggctgcctgcataatgtcctggccttcctttttgcggtgtagcatgcttggagggtgtcttatatatatggactgaaattttcaagatcagaggacagctgttctcaattacctatgttgccctaacatcggatcttctaggactgctttgaatttgtagaattgcttcctggtgtttgcctgttggttgtgaaggcactgaaagtactctctgttctaagaagagtcatccaggctgcctggaagatgctagagagagagatgcaagcctgggtggaggctgccacaggcaggctttctggaagcagtgctcaaatggagtttggagtgcaggatgtttatgaggagccatggttgtgaaaaaaagggggagaagtcaaggttggcctgccaaagccttggcccgactaggcaggagctctggatcaagcatggcctgtagggagttgcccacactgggctaatcattacagattagctaagtctttgcaccccctcctcccccagtcactgctcccagggctggagcagcactgccatagagctgtaggctctgctgtcagagtggtaggctctgacagctggaggctctctgctgaccatgctgcccccagctggaggcaagtcattcctaaaagggaatctagaaggcacaactccacggctccctgagaagcagatgcactggtaggcctggaagaatgtgctgcatccaataagtcctcctgcaattgaaagggaggtgtcagtgtgcaagttgacaagacagcctttgagatgccagggtcctctcagcacaccagtactgccacagacctttgtcacttaggcatgatcatcacagccaactggactctggctaatccccagcttcagatctgagtgctggaaataggcaggcgtcagctgtcttctgtcttatgccaccacgtgagacctttcccacaaaggagggtagacttccagttctagcatctagaagagaataaccgagcacctattagtgccacagatgtcctgcgtgtagcgtcaaagacttaattctctaggctcaagaaggttgtcgtagctctccttatttactagtttttactcacattgctggaacagcataagacttgataactcttggatttaacttgctgtacaagaaaaaaggcatgatgatggaaaacaggaaaatgttagaaaacagccctagtcggtgttgagaaatgccactcttctcacttgctaatgaacatttcatcttgggcttttagtgttgaaattcgaactagattaaatgccattgttctattaaatacataaatgaagctttaggatgattctgtggtcattctgcttacgacagacattggaaggacttgtctttgttaagggcctagcacttcatacacctgtgaagcctggggctagggatatactaatgttggacgtccttccttaacggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctatcaaaacttgttctagaaagactcatacacacaaacttcttgaaaactgagataatcaaggaaatttctgtgtcactcggccaagtgtggcatccccaaaggctctgcagcaaggtcaccaggccaaggctggctctgtaagggccttgccttgggttatctggcccagggaagacccttttatgggacgtgttaagagtggggtcaccacagggcagtagaaagaggaccagggcccagatgcctgggctctggggccgcttctgccactcatcgggaggcccaatttacctacagatgcccagtctgccaggcaggcagggcctgtgttacctacaaggacggcacacctgctaggagttgcgtgctgcaccctgtgccaggctcccatcaacaggccccaggagtccccatctcccaggcaacacgacttaggcaggactaccgggtgacaaaggggtctacacaagaaatgtagggccagaggaggggtcagacctgggcatggggacactggatgtgcagtggcctcgtcaggtcctggaacatttctctttcaagtccctccaactgcatttaggacttcagatcacttgcaaactgctactctcctagctccactgactgccaatcaaaggcccaagaccaaaaacaaacaagacattgtcttttaaccagatcactgtgtgcccatctcacccttgagcagaaggggaatgctgtcttgtactcagcacctgccctgtgccaggctcacctaatccacaacagcctgaggcaggctccactgtacccgcctttactgatgaggaaagggacacagggagagaccgcagcaggttcctggagaacagggctgtgatctgctgcccctgcttccagggcagagtccacacctggtcgttgtctgtgggcaagagcattacccagaccacctggatctgtaacacagtgctgggctcagggcccaacaacaggagaacaatgctggggacggggtgggagagatgaaaggagcaagtgaggcgtcctccagaacagtaactgctggagggcacaagccctccgaggggagctgaggctcatccggaacccccgcagacccgagtgctctcacctgtagtcccgcagcatgaggctggtgtaccgcacggtgtcgtccatgctgcagctgatgagctgccccgactcatccacggtcatcctggacacctggttcgtgtggcctttcccagcgaaggagtcgttctcccccgtctctgaatcccagtaatgtagggtggggttaaggaaaagcccggctcccaggactgctgggtgttctcaggtgtggcttcagtcctaagattctccatttacatcaagaatgagaatctcgccgcaaacggacataaccattccccctgggaagcctgcagtgtccactgttgacacgttcttaggaaggggtatctgaagtgtgggtgcaccacacagggattgggatgaggcagaaagggagccgtgctgaaggcctactggggaccagcaagctggggaggctccggcgtctcctctgctactagttatcgggtaggcgcaaccctctaaccccacatttctttatgttttgggggcagagggtggcatgtctgccctcctctcccagcctggggggacctccttgggtcccggacagtccctttgggaggtacagcacatgcggaccagagctgtccacacaaaaggcagtctccaacacagcacggtgctcagggagggcagcagaacaacgcacagcaggtgccatcatcagcaacgtgtgtgggcatccctgcccaggcactctgcagatggtggctccaaggttcaagacacacccgtgagcagggtgtcaccagccccaggccatgcaggaaaaacacaacagaagcccccatcatcagggagaaaccaggactcatttaaagaaacccagacaaggacttataagggggacacaaacacctccagggaacatcaccgaagggccacaaggcacctcgcaggagctccagccctggctctgtggaccacaggctgcatgactctggggcgggcacatcagctctctgggctctggttttcctatttttaaaacaaggggacccaacgtaagggtgtccaggtgcttgtgaattctaggaatcaagaaacccaccatgtggagtagggccaaggctggcgccaggtgccattggcagaggtagtggcagcccaagctcagggccgttaagccacactctcagggttgcacgacaagaagggactgatcaggtcggagccgcccatggcttttcctcagcataagccctggagttgccaaggacaactccaggggacagttgcctgtccccatgtacagacaggccacccctagaagccacacgggtcagaagagcgtgtggctgtggctgcagctggagccacctggctggcctggcctctggcatcatgggaacaggaaattcccccctagagccagcggctccggagccagctctttgagtcaaaggatattaatgtgtccgtcgtggctcccagagtaaatgtaggacttgccgccgtttttatgcaccgtcagacactgaaacgatatcctgtgaccctgtaaaagagacacactgggcgggtaagctgatgacacactgccctgccctctgccacccgctttccaccaacgaagcttctgggtaatggagggggcanacgcccctcaatccatggcagtgcaggtgctctgaggccccagtagcctcagctgcccgaatgcacggcccacgagccctaagaaacctttccaaagctacccagtcacctacagaccctgcccttcattcccctccctccaaggtacctaacccagacctgggcccagacctgcgtctaaccaaggcccagcacgtcagcacctgagcacctaacgtgtgcagacacgtggcctgcaccccgccgaccagcacccgtcgcggggagccacaagggggtcggtccaggaggacttcgctggccacattcgcttcaggccctggtttgtgaggtttcttctctctccctgcccaggagtgctggccctgctgagggcaggggtctctctgatcactgtaaaagcccaaggctgtccgtgaacgctgacgctcctaccctaacctccctgactgctgcagtggagggcacacaaggctggtccacaaccagacagctgcttccagagggcggcgtttagccccctccatatctgagcctgagacaaaaataacagctagggtgcaggctcctcatgcctttctcctgcaaagggaggccagctcctggctggcccctctcctctgagctcagggcttttccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccaacaccatcagctgtgtcctgtcctctgaaatgcacctccagtcatactttaggattaaattataaagttcatgggaaagctttggcaatttgtgctaagtgctgggaaaaatgccgtggctacagtgctatttaatgtccagggcaaagcagagccaagagaggcattgtaaccagagtgcagctcccccgggaagacacctctctaactgctgctatgctttctctctacaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggtgagtgtggctccctggtcaaccgcatctgctctcatctcatgttaccactgcaggaaggagccttttctccaaaagctggtccctgtattttgcaatttctggtattcaagcctcttacttattattggagaaaagttgtggagttcctttgagtttattttttttaagtacataaagaatacataacaaattgaaaccttatagaatgtttaagtccacccacccagtaattatcattaatagctcaatttgtgtttgtttaggcatcttctgtgctttaaaaacctatataaacatatatagtttattgtggctttgatggaattatgccatacacattgttctacaacctggtgttttcatttaatatattttgggcatcttttcaagacgttagcttagctctacctcattctttagtctcttttttcctgaatagataagtaagtagagtcttccggttttggcttgctgttttgggagcaggtgggcctgaatttgaatcccagttcgatgatttacttgctgtgtggccttagcagggagaaaagaaacatttcactcaggtcgaatggggtggggtaaactcaaggaaggctttttagaagaggtggcctctaaatggactcctgaagggtaagcaggagttaggcaggtgatgatggggattgggacagaggatataccagagaaaggaaatcagtaaagaaaaggctcaagatggggcacagccctgggaaagaactcagatggctgtggggctgaggagaaagcaggcatggggagggtgagagatgaagcgtctgttcactgagccaccacagacttcaccctgggggaataggaagccctggatggcactggagctggagggtgacatggccagatcagtgttagaaggtggctctggggtggaggcggtgggtgtagactagagtgggaagggtggggaggagagaggcagagggctgctgctattggtacacatggtaagggaaggatgcagctgcgactgaggtggtagacatggggataaagaggccactggacttgctaggattcctcccaggggatgcctcccagggatgcaggggcgctgccttcccactcacacaggcagggcaggagggtaggcagagattaaaccactaatgatggtcgaatgcccacttcatgccagactgttctaggcacgaacagtgcacaacagacaaacagctccctgtggagctgaattctagcagcagggggcaaacataacaaattcgcacgtcctagagcagttatgtaaaagactcatttgttatgctggtcaaatcctaacagctactttgtgagtagctcagatatgcagccttggacgcaagcagagagaggtaagggacagagctctcacaaacaagggcatattggtgctgaaaccagaacccgggtctgtgtgctttcaaagccacgtatgggttgtgtcttacacatccaaggatggatcacactggtgtttctgggaatgtgggcgctctggagagaaggggctaattctgcccacagggtcctttctgtcccagctactgagcctcactgactctagggccagctcctttctcattcagtggaaggttttataagtggaggaatcactgtattccatttttaaagcaaattttaaatgttttgaacattttttattgtggtaaaatccacataaagtttaccattttgaccattcttaagtgtacttttctgtgatattataagtgactttttatatttcagccaatcgaggtcacctcagaggcatctgcttctgatcttttattatgaccattctgggttattacggctatgactttagtttcttcttttgcaaaaacagaaacaactcacattttacatttgtggttgtcatatgcatgacgatttctataattaattgcgagtgtgttagaaacagtctctcaacctaagtgaggttccaaactaaagagactcttttgctttttgtttctaaagatattttaaaattctcaaaataaccaccacatgttgataataaaaacaagataacagcctcagctccctaaacaaaaatacatttaaaagtcaatgaagagtgctattgtcctttaggagtaaaaaaagtaaataaatatttacctcagtagagctaaacttttctctttggggatcatttccaaattccactttgtttataaatcaatatcaagttctttctcctgcttgagtccgtaaggtctgtcttcaacctctgtcttcaccctttatttattcattcaccacatttgttaaaacattgagttgattctggagctacagctttgagcacatcaggtacagcccacgtctttcttactcagactgcaaggactttgtgaccttgggaaggtcgactcacctctctgacccagtgtcctcttcagtaacaggaatggttgcaagtcccaaattcccaagccccactcaagcttgacttcctctgggaaaacatcgctggcaaatagtgactgttcagcatatcctaggacaccgtgcacctgtgcctctcccacactgatttccgtttgcttccgcatcttgtcccgccagtcgatggcatcttacttgcgtgcacactaacccagaggcgtcaagtttatccagtcattcaacaaatgtgtagaaagcttctattgtgtgctaggtattgtgccaggtattgggttggctgctggtggtagagtggtgagatcatcaggctagccctgcccttcggaggtcacaggagggcaattgaccaatggccacaggtaataggaaaataggcactgacctctggtagggcatcgggggtggttttcctgcagcagtgacatctaaactcatggcttgaggatgagtaggatttatctgggcgggtctgtaggaagagagaggcaatgggggcggggagttctagccagaggtaagagtatgggggaaggccctggcatttgttcagaggcagaaaaactcaggtgtcaggagcagggggagggggagggggagggggagagggagagggagagaccgctggcaaggcaggcagcagagagggccacacctatgctgtaaatgagcacagggaaggatgggcaaggtgagaggttcccaggacctgtggctgcttgagggacaagggcatctcctactgtttccatcacagacactggcctagagatgacagattttctgattttcaagagacattacaaatccagatttgtcatatttcataatttgtaaatattggaaactgacctttaaaaaacaaaaaacgtcccacctgtgggctgggtctagccttagggccacctttcacacaccttgatggggactgtgtaactgtgaaggcttatttgtaccccaaagcaatgggacatcattgaggacatgatgagtgcttcaagaaggcttttggcctgcagcatggagaaaggattggatcccagccaggactgaaggggttgactggtccagttatgagttgggtcagagtaatggcagtgtggatggagagaggcagatgaggttgagtgaggttagtggtgatgggatgtggtgtcccagagaggaggagtcaaaaataactctcaggcgtctggcacatcagccagatagaatggtggtaccagatgctaagacagggagctatgaaagagaaggagtagctctgcaggggaaaaggtgacaagttcactgatgtgaactgtgcatgtctcagagcaactggaaggaagagctgattcgaggacctgggtacctagattctgaggctgggacactctctcccaggaacagggctcatgaacatgatgccagccaaggggcacagctgcccatgcccaccttctggctttgagctagccaaaaggtgtaccattggttcctataggctgtctcttcccatcagatgggagtttccagacagtcttggccctggccaggaagatgggtgaggaaccctgtaaatatccttctgttttcaaatgtatgctctgggaatgtggatctagggcttctggtccaggaaagaacatcaaatgggaaatttttattcatgtctctggggatttgcagtgttccagccaagtgaaattcacagttatttcactaagtgtcagaatttcattttcactattttaatcatatttcccatttaccttcaaagactgagacaacgaagctttgaaaaaagagagagaaaaactgggcttcaatgaaggcaattgctttgaaacacagagggtgaaggagggttagcaagaaggtagctatttatttattttatgacttcaacttttattttaaattaagagggtacgtgtgcgtacttatttcctgggtatattgagagatactcaagtttggggtataatttatcccatcacacaagtactgaacatactacccaatagtttttcaacttttctcccctctatccctcccctccatctatcccactgtctccagtgtctagtgttgccatctttatgtccatgagaacccattgtttaattcccacttataagtgagaacatgcagtgtttggttttctgttcctgtgttatttcacttaggataatggcctccagctccatctatgttgctgcgaacaacatgattttgcttcttctcatggctgcatagtattttacggtgtatgtgtatcacattttctttatccagtccaccattgatggacacttaagttaatttcatgtctttgctattgtgaatagtggtgccatgaacatatgagtgcatcactctttttggtagaataatttattttctttggatatatacccaataatgggattgctgggtcaaatggtagttctaagttctttgagaaatttccatactgctttccatagtggctgaactaatttacattcccaccaacagtgcataagtgttcccttttctctgcagcctcattagcatctgttgttttctgactttttaatcacagcccttctgactggtgtgagatggtatctcattgtggtttggattggcgtctctctgatgattagtgatgttgagcattttttaatatgtttgttggccacttgtatgtcttcttttgagaagtgtctgttcatgtccttttcccattttttaatggggttatttgttttttgcttgttcaattgtttaagttccttatagattatggattttagccctttgtcagatgatagtttacaattattttgtcccattccataggttgtctgtttactccattgatagttgcttgaattgaagagctctacagaagctcttcagtttaattagattccacttgtcaatttttgtttttgttacaatttcttttgcaattttctttcccaaggccaatgtccagaatgatatttcctaggttttctcgtaggattcttatagtttgaggtctttcatttaaatctttaatccatcttgagttaatttttgtatatggtaaaatgtaggggtccagttacattcttctgcatatggcaaaccaactatcccagcaccatttattgaataggaagtcctttccccattgcttatttctgtcaactttgtcaaagatcagatggctgtaggtgtacagctttacttctgtgttctccattctgtttcatttgtctatgtgtctgtttttgtaccagtaccatactgttttggttactgtaggtttacagtatggcttgaggtcaggtaatatgatgcctctggcttttgttctttttgcttaggatggcttgggctatttgggctcttttttggttttatatgaattttagaatttttttttctagtttggtggaaaatgacattggtagcttgatagaaatagtgttgaatctgtagattgctttgggcagtattgctattttaatgatattgattgttctaatccatgaacatagaatgtttttccatttgtgtcatctgtgatttctttcagtaatgttttgtagttttctttatttaaatctttcacctccttggttaattatttcctagtttttttttttggcagctattataaatgggattgcattcttgctttggctctcagcttgaacattattggtgtatagaaatactactgatttttgtacactgattttgtatcctgaaactttcctgaaatcccctgtcagttccaggagacttttggtggagtcttttctagatcatcagtgaagagagatagtttgacttcttttcctatttgaataccttttatttctttctcttgcctgattgctctggctagaactttattgctatgctgaataggagcggtgagagtgggcaccttgtcttgtttcagttctcaagaggaatgctttcagcttttgcctgttcagtatgatgttggctgtgggtttgtcatagttggctctcattattttgaggtatgattgtttaatgcttagtttcttgagaggttttatcattaaggcttgttggattttatcaaaacatttttctgcatctattgtggtgaatcacctatattgatttgcatatgttaaactaaccttgcatcccaggaaggaagcctacttgatcatggtgaattgacttttgatatactactggattcggtttgctggtaatttgtaaaggattttttcatctatgttcatcagggatattggtttctagttttctgtttttttttttttaatactttaagttttagggtacgtgtgcacaacgtgcaggttagttacatatgtatacatgtgccatattggtgtgttgcacccattaacttgtcatttaacattaagtatacctcctaatgctatccctcccccctccccccaccccacaacaggccccagtgtgtgatgttccccttcctgtgtccatgtgttctcattgttcaattcccacctatgagtgagaacatgcggtgtttggttttttgtccttgcgatagtttgctgagaatgatggcttccagcttcatccatgtccctacaaaggacatgaactcttcatttttcatggctgcatagtattccatggtgtatatgtgccacattttctttttattgtatctttgccaggttttggtattggtgttatgctgatttcaaagaacaaattagagaggagtccctcctcaattttttggaatagttccagcacagtggcgatattgcagtctgacggttttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggaattcaaccttatatttgttctttctctgaaaagaatcttggtattagcttgactaatccttttgctccatgcaattggctagtgccaccttcatatttttctgatatcattaagccccagctgcctcttccctggagctcagggatattgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattgtgaaccacacaccaggtcctttcatggagcttattttctagcctggaggagacacacattaaagacagactgcagcacacaggccgcatgcagcccactgcctgcttttgtaaataaagttttactgggacacaaccatgcagtccattcatttactcgttatctatggctgtgtccacactaccatggcagaggtgagtagttgtgatagagaatgcatggtctgtgaaataaaagtatttacacctggccctttgcaggaaaaatcttcccatgtctgcattaaacaaatgagtacgcaggaaaccaacatgcctgtgaacaatgctatgatgggtgatgagatagagggtaggtgtgcatgtgtgtgtgagtgtatatagtaaatgtgtgtgtgctggttttagaataagtggccaggagaggcctcactgagcagctgacatctcagaggggacttccacaccagaggcaagcccctctgggagcagagactgctcctgtctggtttgctcacgcatgtccccaggctagcatagggccgtaggctggacacctccagagcactgatgtgaagatgtggatgtgaggttgtgatgcagatgccctggaagactaaacacatttactcctcgcgtccactgtaaactacaacatgtgctgtgtgttcatcctctaattcgctgccctgcctgggaggtgcttgctttctttttcttgcagccgttctgaccaccctcatagcactgtgtgtgtgtgtgtgtgtgtgtgtgtgtgtgtgtgtgtgtgtgcgctgtgtgcatgtatgtgcacctgatgccctccccaaccattccatggcccaccttgccaccttgccatcttattataatatcccgatgtcctgaatggacactttccatccaccatgaatgcaatagaacctggaatgtaatggcttacgagaatcagcaacacaaagggagaaacagaagttcagttccctttgttctgatagaaacttactgtttgcatccaccaagaaacacaaccaaagaacagccatgaatatcatcccatgagagagcacatggctgtgtcagaccctgccctgagccccccttctcagtctgaccttggactctgctggaggtccctgctggacgtggacacagggccagggaatggtagggtcctcagttgcattgcatccttgtcgttgtacagatggggaaactgaggctaacaaagagaagaagtctctcctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccactttcaccttctgtgggatagactgcagacagtcggctacatttaaattgggccaaaagaaaggcagcagacacacatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctgcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgccagggctgccccaggagaggccacctgacttgaagggaaggtaagagcctgcgttcatctctgtaggctgagccagagtcagcccagtgggaaaggaaaggaaagaggttccagtagggggttcagcatacacaagggcatagaatcctaagagggcaccatcggcgggggggtaagctgcaaacagtctggagtggagggcgaggggtacagagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatcaatttccagatgcatttttgaaaaatgcaaagattaatcaattgctgcaaccttgcttcacgcttcccatggcaccaagatgagttggaggtactgaggcagtgttcagttaatgcaagctgccctgagccatgcagggggcagaagcccaggatccggggatctaattgccaccttttggtggtgtaaccttgggaagcttatttatttatatttatccctcagtttccttatctccataaaacaaaaaaatactgatgttgtaaggatgaagtacatcgccacccctcctccttcatggacatccactgagtgcttgttccaagtgctttcagtgcattttctcatttcatcccacaacacccctggatgaagggacgactgtttcattttagagatgaggcccggagaggagctgacttgctaaagtttcattacaagtaaggaaaagccagggtccacacaggctgtctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgtccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggcactgggaaccggcaatggcatcatgattaaaaaccggctttgaccctgagacagttgggccaccttctttatggccacagccctgaagcaatgctctttatgagaaaggaaaaagcgagggagagaaagtcacaattcttgagcacctacagcattaataacgagcactctcctccgaatcttccttgctatggtggactcctccaacagggagtctgggagaaggaactggatggatatggtcaccacagcccttctcctccttcagaggcaacctgcatggaaggtgactcctctgtgtctccatgttgtgggtttcataggggtaggcatccacagcggggcacaggggtgggagtaggcagagaagcccatgtcgttttccagtctgcctgtgtctggggaagtcaatttcattgtgggatgtgatgtggggagtccctggggaagtccctaaagctgtgtcctcgaagccagcttccctcggcctaggactgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagggaggcaggtgagaagccgtctaggcaatgggcgttctcccccaagcttagcatgggctgttgttctgctgggcagagccggcactgaggggtgagtgacagctgcctgtccgaagggcatagccctgtgggtcagctgagcaccccggccatgtagtgctgcctggggccatggacctctcagtcacctgggcatgaatgttgaggggaacggagggtgctggccccgaaagtcagaggcctgggaggaaaatgtgcctggctgatgaccacatgtctctaaaagcatccaagacttctggtcagaaatgcctttctcctgggtgcttagggaagaagggcagactcaagcctttaaacttggcctcctagaaacctggcccagtggaacagagcacaggtgacatccaggggcacaaaagcctgaagatgggccatctgagctgaattcctggctttgccacttagccttctttgcacccaggacaggttattcagcttttccaagtctcagtttccccacctggaaaatgagaatgataataccatttttgcagggtagctgtgagataaagcgaaagaactcacaatgcctgaaatagactcatgaacaaaagaggttgccaataaatggcaggaaatatattattcattttaactaaggagtgccctggggatctggtcccaactcttacccgtagctggctgtgtggccttgaacaagttaattaacccttccatgtcttaatttctcatcttttctgatgataatggagttagtctagataccaatagctaatgatcatttactgagcacctactatgtgccaagcactgtattaagcacttttcatgcagcaactcatttaatcctgacaataattttgagtaggttctattatttgctccattttacaggtaaaagaacagaggcacagagtctttggaaacttgtccagggtcacatggctggtaagtggcaaagctgggatcacctacaaaatcttttctgttgttgtgacattacattttcttgacattaaactagaaacagtcaatgccaccacttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagtaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagggacccccgcaaaggtaataggagaaaaggcccagagatatcaggggcttagagagattatgaaattatgggcccagagagattatgcttatctctgtgtaactcatactaatttcagtgtaacaatgcaacacatgttaatctcagcgcaacacatgttaatcttggcgtagcactctcagtgatctgggcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaaatatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtgttggatgcaaatctctgtcccctgtattatgtctttattctttccaaatcaccaaatatttccaatacccatactggcaatttttcataactgtgtaaaatatggttttggtacaatctaaagatgtcacagcttttcttgtggctaacaggacagagccaaaagttaagctgttgctgaaaatgaaggttgttcataactggaatatgcaggaactctgtctcctaagcttcttaggggagttggattagagtatccagtgacctggtgctgaaatgacaacagaatgtgccatggaagagcatcacagttgctgggagatattattacactgcaatcagcatgtgttacattgtcatagggagatcagcacatgttacattgttataatgagattaatatgtgttatattgttacactaagcttatcatgtgttacattgttttacggaaattaacatatatgtttactgatttcagtattttgaagtttttaaaaaagagtttcaagtgcaccacccacaatttcagagtcagaaagtgtgcttacaaaagtcagttgagaaccattatcttacaccatgatgctgacgttcaaatactttggaaagggtggggtgagggacatgtggctttttgtttcgtttccctaaagtctcttgatgaaccagtaacttgagccaatgaaaggctgaacacattctccctgattcagaaatgatctttaaagatggtctaggaagacaccagggaaacagctttgaaagagaaagaagggataaaaacaaccctcccatctgacaatcagtctcccggctctgttcttcttccctccctcctttaagtccagttaaagtgcagcctgttggaagggattagagcgaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcagctctgagaaataaaaccattatgattattgagtcttcatgtagacttgtgcattgatttctcttgggtaaatatgtataagtggaatgactgagttggatgggtaaaacctttataagaaactgctaaaatgttatctgaaggggttgtgccattttatgttcccaccagcagtggatgagccttcctgttactccacatccttggcaacacgtggtattatatcaaccatttaaatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttacaggtatgttctccatgtctgtgacttacctttttatctccttaacaataccttttaaatagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctgttccattgatctgtggggctgcccttatgccaatctcatgctgtctttattcccatgtttgaacattgttacaatccttgctatgtaccaggaatggttccggctgctttatatatattaataacttaactctgattacattttcttggggtaggtgctgttatcatccactattatatccagaacttgaggctcagagaggtttagcaacctggctaaggttgcacagtgagtcagaattcaagtctaggcactccggctccagagtcttgctcttaacctttgtgttctacttcctctccccagtgtttctgaggcaaatacacattcacatttatcaaaagaatatgcacatgctcccaaagtttttctcccttcatttgtgtgagctgcctgaggtcactgagagcctccaacagcactggcactggggcacagagaagacagagccaggagtctctgcccttggggagctttatgggctgaattgcattctctcaaaaaaggaaatattggaatcctaatctcctattccctagaatgtgaccttgtttgggaatggggtctttatttttaggtgattcagttaaaaaaatgtgaccttgtttgggaatagggtctttatttttaggtgattcagttaaaatgacatcatttggatgggcctcaatccatgatgactggtgtccttgagccaatggaaaagggaaagtgtggacacggagacagacacgcacacaggcctgtaatcccagcactttgggaggccaaaatgggtggattacttgaggtcaggagttcgagaccagcctggccaacatgatgaaaccctgtctctactaaaaaaaatacaaaaagtagccaggtgtggtggtgcatgcctgtaatcgcagctacacgggaggctgaggcaggagggaggttgaatcgctggaactgggatgcaaaggttgcagtgagctgagattgtgctactgcattccagcctgggtgacagagtgagacattccacctcagaaaaaccaaaaacaaaaaaagacatacacagacagaatgtcatctgaagatgaggcaggggttgggatgatgcttctgccaactaagaaacacccaagatcacctgtaagttcctggaagctgggagagaggcacgggacattctccctcacagccctcaggagaagtgagcactgctgatgctttgctctcaggcttctggccttgagaactgtgatacaataaattcctgttgtttaagccacgtagtttgtggcacattgttttggcagcctgggcaaaccaacacaaggagctaacacctgatggagggcagggcttgtaatgttgcctgctaaatgattgaatgtatgtaaaaaaaagaaggaaggtagtctccaaatatgtacaactattatatgacaataaacaacattttaaaaaggaagagctggagggcaagaaaatatcgcctaaaatttaatttatttcaaatttatctcaattaaagcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgcctggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccctccctccccctctctctctctctttctctctttcaaatttacattttaaagcaactctatgaggtttcccctaataactcagccaaagcggtgcagacaactgagactctttcagagagaaatgtaaatgctggggcaagatgtggcccagatgagggccaccccgcaggcatcccaaacagctgtttcctaatcctgacatgttggaatggaggagtacctgaggaacccttggcacatgagcaattggtgactttctagtcagaagttggattattgtcaaagttttagctgcaaaaggatgggagaaaggagcagagaatggtgtgattatcactgacgcagctccctctgcagagaacagaaggccaaggtacattacatgaaaagcaatttcacattccagtattacttttagctgctggtaatcctgttttaaacatgcaaaggctaatctttactttcacagatctctctaaaaagaagccaagaccttggaaagctgtggttattgcaagttagtgaaattttaaaatttatgttcagaggacagagtgccagaaacaattttctgcttgggacaggctctctctaagttaaaaacggaatataattcaatgaaacaaacttttttgggaatttctgcttaaaagatgaatgtgcataaaaggtatcggtgtatctgtttgggccaaaggtgtgagaaatgagagttgtgttttaaataatgatcatcccagggtggcccatgatctctaagtataacaaattaaaatgtcttgagatatttcagccaaagtgcaaaacagacatgggttttccttccatcccatgccaactgggatggaaggaaaggctggcagcagacaggcttttccaagttctccagtcctgtggacgtctcctccacttgggtcactttacaagcttggcttgaggccgtagcttctgcagtttctaagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccgcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttcccttcctcatccccacccagtcctcaccccatgaggataacctgtcataaccagaagtattagttcattctcatgctgctataaagaactgccgaagactgggtagtttacaaaggaaagaggtttaattgacaaagttccacagggcgggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgcttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactggggacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctattttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggctcaaatcaacaagctccctgccctctgacctctaggcggcttcagcagaaatcagaaatcagaggtcagaaatcagaaggcaaaagaaagagaatgaggccaggggttggtttcttggttcactttctacagagacattttgcctggctttgtccctctatcaaaggttgcagctcctgataggtggcgtacccaccctacatgccctcggctgccctgaattaatctgccttcgagctgctcaggttcactgtgtccctctttcccaaaggtttttctttcagcagcttcttttgcctgacatgctcttcccagacagctgggctcacctggagcctgaccacaatatttaaaatggcaactgcccccgtctctccattcccctttctctgctctactgttttctcataacatccttcaccttctaaaacactgtgtggggtactcccttgttacactgtctgtgaccccatgaggagctctccttctccacagcagagacctttgtctgttttgtccactggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagggtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattgagtatgttctctatgccaagcactgtgaattacagtatgattcccatgacaatacctgctgaggcttagatctgttattattgccactttcactaagagaaaaatgggtatcagagaggttaagtgactagctcaaggtcacccagctagcagctgcggggccagtatgaaacagagcccagatgatctatcaccctgctttctcccttttaccacgttctgctctcacacgggctggatccagtgtcctgagttccagcagtaaactctgaggcctttgattctgaaattgtcgaatttattgggaagcaatggagactacaggcaacagaaaccataaggattttttttttttttactacaagtcaagagcatattccattcttgctaattatgaaaatgtactgcagtgaatcagaatgacttcctgtgaattctgacccctgatttgtaaaagcacagagtctgtgcttctcaagagtgagccctcaccccacaaagctcctgccccacatggcctgaatgacgctcactggaagttcactcatcagagagttaacactgtgccaggcaaatcaatttggaaaaccagctgtttctgaaagatggcgattatttacagttccccaagctgatgactgacgccctgagccaaaattaattgcagatcaaatgagcaaagatgtctttcccctctcaactttattagcctcctgagccattttaatagactgtcaaaatctcataagaggaatgaaaaaaattggaaagtctttttggataagcaatcacttcaaagggctggatgaaatatatagacatatatttgtgtgtttattacatatgtaactgtatatatataaatatatttattgccttcttttcaaatatatttcaagatatataatatattttgtatattatataaatatataaaatatattttatatattataaattttatatatttatatattttatatcaataaatatataaaatatatctacatattttatttccttgttttcaaatacataatatataaacattataatatattatgcatattatatatataacctatataaatatgatatttttatatatacataactttggaaagtgcaaggaacttaccttatattgatgctctgtgaggaacaggggagtggctttcacacactttggattttgtttccataattctgtcagatgctgtattagtttcctattgctgctgtagcgagttaccacagactcagtggcttaaaacaacccaggtggattatcttatagttttggaaatcagaagtctagaatagatcttgcagtgcaaacacgatggtgtctgcagggctggttccttctggaggctccagggcagaatcttgcctgctgcagcttctagagaacatctgcattcctgggcgtgtgaccccttcctcaccttcaaagctggcaatggcgtcactcctgcctctgcttccaccatcacatctccttctctgactctgaccctcctgcctccccctttcacttacaaggaccctgtgataatattgggctcacctgggtaatccagggttagctccctatctcaagattagtcccacctgcaacattcctttgtgccatgtaaggtaatatattcccagcttctgggaatcatggtgtggacatcttggggagccattgttttgcctaccacaggtgggaatggttatgtccattttacagatgagcaaataaattcagatgtgttgggcaatgttcccaagaccacttagctggtaaatgggtgatcaggatttgaattcagagtagcctcatcctaaagccaaagctgtttctccccagaacatttttctattccacactctcaacctcatgctgaatttagtttcatgcctttccaggaattggggtcaatgctaccattttaaggactgtttccaatggactattctgcatccatccttgcatctccagctctttgagaagatgaaagggggacagactacccaatgcacttcacttcacctaacttctgctggcccttcagctctcaggttcctggtccctgtctccaggaatccctcccagaaccccttatttgagagggaagctcgtctcagtgttgcatgtggtaattgtttccaggtttgcttttctctctagatcacggcaacgtcacctgtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttgcaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccactctcttgggttctgagccagctgactgtgtgacccagagtaagtcactccttttggtcttagtttcctcaactgtcaaaagatagcaagaccccctgtaaaatcctgctctccacaaggatgtccatcgtagccttatgtaaaatcacacattatggaaatctacctaaataggacaagaatagttaccacttactgggtgtataccatttgccagccactgctggaatcacttaatgtatattcattggtacaatcctcagcccatccctatgaagcagggatgatggcttttagaagtggggaaactgagtcacagagatgctgaataacttacttgggggtcacgcggctaataaaaagacacagagctgggactggaacccagaaagcatggcactgccatcaggttccgagcagagacattcaacaacctcacccgcagacaatggttaaggaaattatcatacagaaaattactggagaaggataaatcgttcagcactagtgttaattcagggaaggtgatgatctacatgattttctgcatatatgatacacttcaacaaaaaaataataaataagaaaatggagagtcattctgacataagattatgtgaacaaaagcagatcagagctcgtatttagaataggattactgtgctactatgtaagaaatatacatctatgcatagaaagacaagggaagaatttgccaaacttccttgggtagtatgattgtaggtaatttcttctttgttcctctctatttttccgaattttacaaatttgccctaatgagctggtattgatttcttcacaacaccaataaaatactttacaaaaaacaaaaaacatctcccgtacttcccccataagtttcatctcagactgtgtttttccattgctcaaagtaaaaataaataaacaaaactgggtgcagtctataacttgagaataacaagaatgaatcttgtgaaacttccagaatgtgaaacgttgaaatgttttcttctaataaaaagaccacaaagtggaaagggaaagagacaaaacatcattcctctacattttttatggtatctattttttaaaagcatcttgttagaatgacccattaagtgcaaggtacaaaatgaaatgttctgtcaacaagaagtcagaaagacaattgcaagcctctgcctgtttgcatgggcatcaatcttgtcagtgcaaatcagtgagcaagagtgaaaataaatgaactactccatcaaggtcagagaatataactctctaattttagccctctctttccatttggaagggagcctaactgtgtgctgtgtgcccaaaatgtgaggcacagacatagctacaaaaaagaagagacacaagcatttcataaagaggacaactgaagctcagagatgttgagtgcactgctcagtgctacacagccaagaagtgccggagccaggattcaaatccagtttgatctgattccaagatctggaaatttctactaggttctgaagccacccaactttcccctccaccagatgtttgttttgcatattggaggttgagaaacagtgaggagctctatgccttcttttgaacatattggcttattattaaggtcttcctctctattatactggtcaactgaatgtcctttctcctttgccttgcaaactcccacatgtctggggtaatgagatgactgctaatggttttgaaacattttaaatgtcatggtaagagattggagattcaagccaattctctgatccgaactcctggggacaatatggccctgtttcacagggcattcatatttcatcatttgtgactaggtgagaattcaaaggatggagttatttattaaaaggaagatgacagggaagcaaaatctaggaaggaaatattctctagatgggtaaaatgtcagtgaagaatattctctagatgggtaaaatgtcagtgaagagctgcatgatgacctcctaaaatccagccccctttggcatgataaaggacatgctcctctaaagagatgcctgtttgttgccttaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagatagaaacagtaatgttggtggggcttccaggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatcgtaactttatgagaaccagaaaaggtccccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatgacacacttacattgagtgtgtcctgggaaaaccaggatgtgtggtcttggagttgctataccagccctcgcaacttatttcatgtgagactgaaaaccttccatcttgttgaggtctctgttggggtacctgccacatgaggttagacctaaatcctaattgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaatctgtttgtgacacgaagccactgccctccccctacatcagctgatagagtgggaaggtgactgccttcagctttacctctgctcacactgaagcttatttgattggacagtttgagttcactgtaaaataagaaagcactcaggaaacttaagagtgcatcctgccccggagccccgccagcccccacggtgtgtgctttgtgttgaccttgttcaccacacaactctgttctcgcaggttgcccctagcctccccgtgcagcgtggcaggagcagcagttctggaggcatagagtggggattctagccccagcactgtctctcatgacctgcgtgaccgcaggcaagcgattttgcatctcggaatctctgttctccaaagaaaggtaataatacttcgtctttcagggttcttgtaaaaattttaatgatgataaaagaaatcatccaggacagcacctgttataattggcatataacaaattgtaggtatcattctagaaggttctgtctctccatggagatgtgattgcttcttggttaagaagagcatctggaaccaacccaaatgtccaacaatgatagactggatgaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaattgaacaataagaacacatggacacaggaaggggaatatcacacaccagtgactgttctggggtggggggagcggggagggagagcattaggagatatacctaatgttaaatgacaagttaatgggtgcagcacaccaacatggcacatgtatacatatgtaacaaacctgcacgttgtgcacatgtaccctaaaacttaaagtataataataataaaaaaaaaagaaaagaagagcatctgacagtggcacatatgccatgctaggaatgcacctctgggtctcttttcagcctccttcttgtgggatggggctttgaagaactgtgcagctggcaggtgtgggggtaagggcagcaggaaagaatttgggtcttctcaagtccctgcccttaatgccctgaagctctcattcttaactcacgtcatagtgttttagagacaaagtgtaacatacataatcatttttgccccctccacagttgggcatgcctaaggatgcccaacatgtctaagaaagcagcatgtctaaggatcagtcaagggtccataagagtaaacatcccatttacttttgcctagaacaaggtgatactgacaaagagtatgggtttaatttatgctttctggatgtggtgagcagaacaacagccccccgctctcaaaatgttcacatgctaatcctgggaaccccagaacatcttactttacatggccaaagggactttgcagatatgttaagttcagaatcttgacatggggaagttatcctggattatctgggtgagctgtaaatgtaatcaccagggtccttaaagagggagtcaggaggatcagattcagagagaagacgtaaggatggaagcagaggtcagagaggaagaaatatttgaaaatgccatgctgctgacttgcagatgcagaaaggggccacaagccgagagatgcaggtgccatctagaagttgggaatgtcaaggaagtggatgatccctctggagtctccagaaggaatgtggccttgccaacaccttgattttaggacttctggcctccagaattgtaagataataaattggtgtggttttaagccaccatgtgggtggggctccttcaacaaaataatagctaagctattgcagtaatttgctacagaagcaatagaaaactaatatatactggataaagatataattaatatattttatgcatttcctgtgtgtttgtgtgtgtgtgtgtgtgtgtgtgtgagagagagagagagagagagagacagagagagagagaaacagatagagagagataaagagagaaacagagagagttgtaaacacagaggtggccgccacagacaaatggtgatgtataggatctatcttgaagtacagaagacagagaagaccttgcccatttattaaacactgtgttccaggaactgtgccgatgcctcacctactgtttccagggacctcctttcccttctatttcctgtttccatttggggagcatccactagggaacatacctccctctcaacccaagggacagggaggtagggagtgccctcttgcatcccctgggctctttctgtatctgcctcctgcaggaagctggagacgtgtctgctgcctccacccaaggaggggcttgccctgtagaggggtctggggttgctccttctgcctgtggctgggtctagcatcttaaagctagaggtgctgaactaactgccacttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattgcccgagaggtgagaggaaacgggggcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccagaagcatacaaagtaaggactcaaattttaagagtggccagaaaatgcttgcttttaaaagcttttctaagagtgttggatcacccagtcttgcttctcatcttacggataaaaatctaacctcacactgacctagccattagcccaatgaatgataccacctttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagcgattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactcaaaagttcaatgttgcaagctgcatgcaggcagatgaccccaagcctggcactcttgaccacagttcagggtggccatatggagggtctcttctcagctttctccctgttcatcaggacatagcaaactgctgcagtgagatggtctccacttttatgattacagagcattttagattcttccaacttgatctaggaagtgatttcaggagaatcttttgaaaaccaaagttattaataactgcttctgaaattataatttgagactttgtacaaaacttgatttgggctccagaactcctaatgatggttcaacaaatcagatggaccttcatgtggttccaggccaaaagagggggaaagtaccacagttttctgtaaacacatctaaagttttcatgtctccttccccttgttcctcccagtcacctcccttccctcccttctactcaactgtttagagaaagcgtaagaaatctgggactctcttaggcactaaggtgacagcagacaacacaggtcctcgtctaccctagaagacctcttagtctagcaaggaagggaggagtacacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcgtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggaggcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttccttttttttttttttttttttttttttgtgatggagtcatgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaaacattcatcagctccttagcataaatatactgagccatctgtgatgtttgcttgatacagaggttctcagccaggggcaattttgctcccatgggatgtttggcagtgtctggagccatttttggttgtcacagctggtggggcagatggtgctactggtacctaatgggaagaggccagggaggctgctgaatagcctaggcacacagcacagcccccatgacaatgaattttccagctcaaaatgtacacagatatgaggctgagaaatgcaagtttggtacaaagtgtctgggtgggctgtccagggagtgcacccaacaccagcaggtgtgactttgtctgtgcaggcaccacccctgggaccttgggcaatgcctgaccctctgtgagtcacacgtccttcatctagaaaatggggacaataccacttaccctgtggggctgtttggggcttgaataaaatgacaaacacagagatgcctggcagtatttacggatgtctccagtgacatgtcatgtcccccaaataatgtctgggataatgaagaagacaaagcaagtcttccaaggcagctgaagttttggatcccaggggtggtgcctgcacagaaaaagtcacacctgctagtgctggtagctctctttgtcccgtgaatttggatgacaaggcagcaggtacaggggagagctggaccacagtgtggctgtgatgctggcatttgccactaaacagcatgggtctctctgtatgtaacacggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggcccgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaattaatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgctcaatctgctgactttaaccagaccaaggagaaaggtaaaagcaagaagcaaggtgatctcatttcatcccagtgtttccgaaaatagaaccaacagttgttgaaaggaggtggaacaacactgtggttgtagatttctatgctgctgtttttccttctctggacaggaatgactccccttcacatcaccttccctagacacccccaaacaccctccctgcccgccttggggggtgctggtctcacgcttatttagtataaatgcaagctgtcttacctggggccctttggaagggtgctggcgggtgccccttctccctctctctgggttcagtcagtctcctcccaagtgacatgagtgacctcagaggcagtttggatgctttatgcaagaatctcctctacgctcccctgccaagtggttggccagcctatttgcacacttccatagatggggagatcaccacccctagaggcaacccactccatttgtcagaagcaacagtaacagtaaagatccagactctgcctccctaagtctccaactgggaattccacctttgagtgccctcaagggagaggagactgctgtgaacatccaagcatctggggaacctcatggagagacctcctcagacttccctgcctgcagcagctcaagccccagaacatttcttacttaaagccttgaggtttttttcaagccaaagttgtgagttgaagacagcccagtcaagagtacttttatgaaaatcatctgaatgtctctcacttctgacttcctaatatcaattttttaaagaaatataacttttagacatgtctaggaataattagtgatagcatttattataggatatctctgtggctagcagctgaactgaacactttgcatggattgtgtctttccatattatgtgatcccattttacagatgaggaaactgaggatcagtcaagttacatggttacctaacagcatagagtttgtggcaatgacagaactgagatttgaacctgggcgtccggggcccaagccctgaacctccccaccctctgatccctccagtcatgcaaggatgcccaccgggccccaggactcactgcattgaggccacagagctggtagcaggccatggtgacaatcacggtgaccacctgccagcggacgtagggagctctcagcagctccagcacggacaccaggcggatgctcctctgcacgcggctctcagccaggacctcctctacctcttgggaaatgtctgctttacccaagaacgtttggaaggctgcaaacagaggcacacatggactttcagcagggattagagtgtccatcatgtctaatgctgggccctgcagggacgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcaggatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgatttatgccttttccatgttgaacactgcaaacttccagcctcagagaacccatcattttttttttaaatgaagaccttaattgtgcaaacctctatgaatgtgtgcttgaaggcgggctgactgattagatcccggaaagcacaataatcagatcatggggtgcacttttggacacagatttcaatgctcagtgctctgatctttcttcctcccacagggaaaggtggctattgtgctggctcctgcggacagtccattccagacacagcaggcagcatccctaaaacatggctccgcccctcagggcgtgtgaaaatgctcttcttaagcaaatgccattaaacttgctccagattctccaagaagcaagaacccttccgaaggctttggagtgttatttccagcagggtactaaaaactgcttcagaatatctttttttatgaactataatttaatgctctccccagcatttattaagggtaaatgagaaaagcagctgaatgagcaatgtttctgtttcatgcattaagtataatatttctactgtttcctcaaagttcaaaatgcaacatctatgtgataaaataactctagacttctggggtagaaaactatttctttccttcatgacatacatattttccattataaaataaggataacttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaacgccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagcttcaatttaaccttcctattgtatatatgttcataaagtgggtgatactgtttcagagtgacccccagcctatgaatgagcaaggaggcagtccaagggcccagccatttctgtccagtgggggacctcctgcaatgcatgagtttctcctgagtttctccagagctctcccctggacttgccaagactttgccaggggcactgtggcctgatagctcctcctgcccagttcttctcccatccttgtcactttccatgtgttattctccattgaaacttctgctctcctaactcgttctcagacctgcttccaggagaacccaaacctgcaccaaggagttacctgccggcgcctcccacacccttcagcccctgcctcttcagtgccctgcaggaccctggcccaagcgcaccagccttctatttccctaactgccaggtaagtccgccccccacccctccatgactccctcactattttcaatcactcctaacaacggcctgttgggatttgggcttggagtcctccctattccacatgcaccctttctggctgagggctcacagatattcttttgaaaatagcaaacatagaagactgagctggagtcctgagggggcaccaaggagggggcatttcaggctgccagagaaggcaggggcactctgggcaggaggcagaaggatggaaagttgtctcctattcctggcactagggaaaagcaagagacattctgtaaggtacatggatgtgctttggtcaaggaataggccgaggcaaacatccaggccagaatgactcagtgagtttaggtgcacaggtgcatactccacttgttatataacctgtttgtgtaagttcatacttggcttggagccactattgtttgggaaggtataactgccctgctgacactgtacgggggctcttgggcatggctccacatgactcttgtgcagctgctggcacccagagaaagagaggagagggataaccagagccgtccattttgcagatggacagaggggagccagggcagggttcggcacagcacggcatggcacggctcacgcttgtgcccagagagagaaagagttaagctgctgaccctgaaggcaagggagagctggccgtgcagctgagcgtgggagcagctggctcaagcagctgagacagaacggacagtgtatgagagctgctgatgagagagctgctgagtaaaaccatattcacctgcttacggccccccgtctgttttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaacctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaatcactgttaccctctcatccgggtcgctcttgcacctgtgtctgtctctcttgggcactttcactcttgtctggggcgttctgtctgcacacctgctgtgcccacccctgggagcgccccctgaccaggggccatttaagggatgctgtgttactgtggaaaggggtgggccttggagtcggagcaacctgggcttcacacccagccctgtctctgctaaaagaccccagactagttacctattctgcccgccccatgcttgttcttccatgaaacagaaataataaaacctacctatgaggttgttttggggaataaaatcaatgtgtgttaagtgttggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccatggtcctcagacaccttcagagcacagcagagtgacagacactgatgcatctgggggtggcccacatacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcagggccaatgggtgctcactaatgcaaacacacattgtctcaggaccagtgggtgttcaccaatgcaaacacacattgtcttgggccaattggtgctcaccaatgcaaacacacattgtttcggggccaatgggtgctcacaaacaaatcctggctgcaccattttctatctagtatgataccaggtgaagtatttaatgtttccatgcctgagtttccttgtctgtaaaataaacataatagcattggtggtgtaaccagtgttcgatgttggcacacacaaagtcctcagaacggtatctggctcttgatgagcaaggagcattatgaatatacatgctatcactgtggggtacttgctacattctccctctccctttcatctttagcctggcagagggtacaaaatgctataaccttctgttgtgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcctgcctcagccgctcgagtagctgggactacaggcatccaccaccacaccgggctaatttttgcatttttggtacagatggagtttcaccatgttggccaggctggtctcgaactcctgacctcaggtgatccacccgccttggcccatcagagtgctgggattacagatgtgagccacttcacccagcctccagtgtgtttattactgaaaaagtgtgatttgtaaacttcagatgaataatcttctacattaatcattattcaaatctgtaattattcatgtagtttagtgtttcagaaatagaaataacaggttaaagagtgtaaatttttttaaggcttttgtacatatgagcaattttttttcggatagtctgcttcaatttccattcccgctggcagggcacaagggcattagtctcactctgcccatgtcatccacaagcatttaaatgaggctttggtatttgataggcaaaaataatagatgagaatttcttatatctatatttgtttcctgttgatgctgtaacaagtaaccacagcagagacagaaatgtaatttctcacatttcgttagttgataatcaaagtattaaaagacctcactagtaaaaccatctcaccctggagtcttttggggaaaaaaatgctttgaatatcttttaactactttcgtaaaaatctatttttattttcttttgagttgatgtcattaatttctgtcttttcaataaagtcacttatgtcatcgaaactttcaaatttgttagcatacaactatataaatttacaccatttaaaaaataactgaaatgattttaagaatcaaatgtaaaaacagataccataaacaacacacaaatgaatacagattaattatttagaacaatgttttcaattgggattttgggattttgtagatgggattttgttatcctcattcattaccagttttgttttattacataaagaaaggtcatccataagtttcttctttggggaacatatgatagtttattctgtggtcagtttgtgatcatcttttgttaatattccatgtttgcttaaggatggcagctctttcttagcacttaccattttataatggtaaaaaacagatccaaaattacgagtgatttttattatatcacaataattatggttaatccgtaaaatacagaaaaatttcccatgagattaaaaaagggtgataatgtgtgattctattagagagaaatgagcttcaaagggaaaggcccaaaacagcctctgcagggctgtgtagtgggcacctgggccctcgtgcccgactgcctggatctgcatcacagctccccacacctctcacacacacacttgctgtgggactttgggcaagttgctaacctctccgagcctaatttgttacctaagcaatagcattaataatgggacctctttcgtggggattttgtaaggcttaagaaagagaatacatgttcagcacttggaacagtgcctggaactggtgccaaattgatgtcagtcatcgcgtcatttatgtcatgtggcagtacttagaaaagatgttatgaaatttctattttacaggtgaaaagctcagtctcagagcggggtgataattactccgaatgtctgcagcagggaggcagtgggacttgagcttcctggttttgcagcccataatttctctgtggtaggaccaatgtcctgacttgttgatggagaggcaagagggctgtccccaaaggttagagtctgatataggaatttgagcaaaacagtcctttgcagcctcatattcttctcatccagaccctaagtgtttgaaagcacttgttttctgtgaactttttgacttagaactctctggacttcattcaagtccaggaagagaagaacttttgatttttatcaagaatattagaagaaatgtactcatctattttaaagtgattttaagccccagccacccagcaacatcgtccttatcctccactgacctgtaaatcctaccgtttctctttgaaaagaagattcatttcggggcacgacccaggcattttctgtagccagagcaaatgttcagatgggttgaaggccattgcatgatgaatttcctttgaagggaaataggagaaaagaagattagaggttgtcacctttgcattcttcctgccacttcggagtccctcacaggttaatgcctgaactcctttaaataacaaccagagttctcaaaacgtgttcccaggaccagcagaactggcaccagctgggaaggcacttgtttgttagaaatgcaaattctcatccctgccctggccaatccctgttgaaccaagattctgaaacctacacgacatgtataatttcagactcttttgtatacccgggtgcatacaaaattggctttaataaacattcagcaactcttttgtaagaattctcgaatgtctccccctcgatattcagtgttgactccctgatttccctctgcagggtttagacctcccaggatggtgacgtgccaggtccgtatgacctggctccacgctctttatctccacccatccacccctccacctcacagagcagctaagcccaatagacagcacattggaattaacaagcgtgttgggtgtttgttaaatgagacttctcagccccattccagacctcaagatctgaatcttgaagcaggtggttccccaagaatcttcattgtttatcagactcgctgggtgtgattcttgcacacacaaaaggtagaggatcccactgtgactccacatcccattccaggatcccacaatgcgggtcccacctcccagcctctgcctttgctgtttcttcctcccaacctcctttttctacattccctgactgttgtcatcctgcaaaacccagcgagcaggggcctcttgagaggccctctctcctgccagccactagaatcagctgtccccatctctgcctcccacaaacagtactcctctctcacagacttgctttgttctacatagtggtcaggtggtcatccgcgtgtccacctttccctgggaccaaagtccaagttctcatctttgtatcaacgtagagctgaccgtggggtctgtagcattgagctaccccctcaatgtggagggaaggtacacatttcccttgaccttggaattatgaagaacaccctgattagtgaattttttaatggtcctgaaatggcttggctttatccctacccaaatctcaccttgcattgtaataatccccacgtgtcaagggcagggccagttggagataattgaatcatggtggtgctttcccctatactgttctcatggtagtgaataagcctcatgagatctgatggttttagaaatgggagatcccctgtacatgctctctcttgcctgccaccattgcaacatgtgactttgctccttctttgcctttggccatgattgtgagatcttcccagccatgttaaactgtggaagtctgttagacctctttcctaatggccctaatgcagcgagagagggccacggaaagctttctggagaaggtggcatccaccttggggtctggaggacaattagccaaatgaagggaagaaaaacaccattccaggcacagggaatagccagtgcaaaaacaaaaaaagaacaagagggagctctgcacatttagaaactgagagtgatttaataagagtgccagaggtgacaacaagtgatgaggtggatggtcagctggggccacactcatccactccctgcctctgcacacatctgcagtttcagtaacacctgcccaaacatcttccttttttaagttttattttaagttctggggtatatgcgcagggtgtgcaggtttgttacacgggtaaacatgtgtcatggtggtttgctgcacctattgacccattgcttaagtagtaagcccagcatgcattaggttgtttactgtccctccccctgcccaggtcccccgataggccccagtgtgtgttgttcccctcactgtgtccgtgtgttctcattcttcagctcccacttataagtgagaacatgcagtgtttggttttatgtttctttgttagtttgctgaggataatggcttccagctccatccatgtccctgcaaaggatatgattttgttcttttttatggctgcatagtattccatagtgtatatgtaccacattttctttatccagtttatcactgacaggcatttcggttaattccatgtctttgctattgtgaatagtgttgtaatgaacatacacatgcatgcatctttataatagaatgatttatattcatttgggtatatacccagtaatgggattgctgggtcaaatggtatttctggttctaggtctttgaggaattgccacactgtcttccacaatggttcaactaatttacactcccactaacagtgtaaaagcattcgtatctctccacagccccatcagcatccgttgtttcttgactttttaataatctccattctgactggcatgagattggtatctcactgtggttttgatttgcatttctctaatgatcagtgatgttgagctttttttcatatgtttcttgaccacatgaatgtcttctttcgagaagtgtctgttcatgtcctttgcccactttttaatgatgttgtttgtttgtttgatttttataaatttgtttaagttccttctagactctggatattagacctctgtcagatggatagattgtaaaaattttcttccattctgtaggctgtctgttttctctgatgatagttttttgtttggttttgtttctgcgcagaagctctttagtttagttagattccatttgtcaatttttgcttttgatgtttttgtcatgaaatctttgcccatgcctatgtcctgaatggtattccctagattttcttctagggtttttatagttttgggttttacatttaggtttgggttttacatttaatccatcttgagttaatttttgtataaggtgtaaggaaggggtccagtttccattttctgcctatggctaaccagttctcccagcacaatttattaaatacagaatcctttccccattgcttttgtcaggtttgttgaagatcagatggttgtaggtgttcagtcttatttctgagttctctattctgttcattggtctatatgtctgtttttgtatcagtaccatgctgttttggttactgtagccttgtagtatagtttgaagccagcctccagctttgttatttttgcttaggattgtcttggctatatgctgcccaaacatctttctagcactgtgctttggctgggtcactccaagcctctctgtgggaaggggcatagcatgacggaaattgctctgacttgggagttaggaagttgaaggtttgaattctacctctgctgctttctagctgtatgacttgaacaagttacttcacttctctgaggcttagtttctgattctgtaaaatgaggacaataatattaatacatactccatggagttaatgcaatgattaaaagagacactatatgtaaaggactttgtaccgtttctgcaaatgggagccatccagtcaaacaacagatcctgtgtccaccaaatgaagccctaatccctcagtctagccttgaaggctcccgaatttgggttcagtctccaattttaacccattctatcctctagtgccattcaactgcccccatttcccttctgctgactatcatcccataatcctcatgccactccctgggcctggaatcacctctctcatcacccctctcaatccatgtcactcagccttcaagaaaagcctaattcaaacaacaacaacaaaaaagaaatagcattttcacagcccttctgaaaatggaaatgagaagagatgctgaatgccacgtgagctttggctcctgacaaaagctatctcttcctctgttgaattttcacatgctgtgggtgcctttgatcagataggggtacatggggaggagctgtgtcttcttgcttccctctgacttcaccttcactgtaaacccttaaggggctgggccactcctgttcatattcccctttcttccctggcactgcccagcatagagtaggcatcattaatattgtccaccaacttaggtatttgatggggagagttaggcagcattttgtattaacttacttgtatagagggtgatacctggggctggtgaaggggaacttattttccaggcagaaaggcctattttgcatctttagtgccagtctgtgcagttttagcggagcctgagtgacttgggtaggctcaaggccctggagagatgtaaattcaaatgctgcacttcaataactggatgagacagatgttgcttctggcagatttcaaattctaatatttggaacaataaggctcctctcctgtataacttccttgacttgcggcttttccaagtaatgcccactgataatgattcctttccatgctttaaacactgggggagaatataacccagttagccctggttcctgcccagaagggcgtggtgttgaagtgggacaatgcttggaaataaattatctccctgcctaccaccaaattcatctagcagtcaagtcggaccctgaatgtgactcagcccctccccgaaagccagaacatccacgtttcttaggcccaggatacagtctggttgtgcagctcagtcacagcaaatggagcctgagagtgtagaccagggattcactaccaaaaacaaatctcaaaggggcacttgaaactccagaaagggaaccccaaaggaaaagtattcatatttcaactaatctttgtcttaaattttaaattattttagtcaaaacaatgcaagcaaatgattgaaaaaattcaatactgctaaaaggcttatagtgacacacagaggtccatcgtcccaccccctcaagctccctgtctgctctccagaggcaatctcttacaactcttttacctgttatttgataattccaccatattttaaaataattgatgatagaacttttaaattcattttctttagatattatccattgatgtctaagattgagacatcaacctgatgattgaggcctcagtattcttttttttttttttttgagacagagtttcgtgtatctccgaggctagagtgcagtgcagtggcacaatctcagctcactgcaacctctgcctcccaggttcaggtgattctcctgccttagccatcagagtagctgggattacatgcccccgccaccacgcctggctaatttttgtattttttttttttttttagtagagattggcctaaatctcactaaagagattggccaagctgatctcgaaccacattggccaggctgatctccaactcctaacctcaagtgatccacctgccttagcattcttccagcaccatccctcccttccccttctctaacctaccaatacacatatagtacaattttttattagttcactggttaacatttatattggtatgactatttaccgattcctttctcgtacaaccttttgtttttcctggagttattaattccatcattgtttttattttcttatttgcttagttttctaactacctacaattaattttttcaaattctccaatattaaacacctggtaataaatttacaaaattcttaagtgtatcacagatgttctatcactttatttttgtacctcagccctctagcctgttgctttcgtctaaatgggtcttttctggacaggtcctggtgcagaacagtcctgggattcttgcctctctcctgggtagaaaccactggttcctggatcctatgtcctcctcttcttgttttttgttttgtttttaaattattattgtactttaagttctgcgatacatgtgcagaacatgcaggtttgttacataggtatacatgtgccatagtggtttgttgcgcctatcaacccgtgatctacattaggtatttctcctaatgttatttctcccttaggcctcacctccaacaggccccattgtgtgatgttcccctccctgtgtccatgtgttctcattgttcaactcccacttatgagttgaggacatgcggtgtttggttttctgttcctttgttagtttgctgaggatgatggtttccagattcatccatgtccctgcaaagtacatgaactcatcctttttttcttggtttattttcttgttttgctaaatcatttcctgcagtactttcctaagaagaaaacatgcaatgaagacaaagcttttgagactttccatgtctaaaaatgtctttattctatacttatacccaatagatagttaggctagatatagaactcttgtatgaatataattttcctcagaattttgaaggcattgcttcagtgtcctgtagcatctgacattgctgatgagaaatctgatgcctttcttatttttgatcacttatatgtgaactgttgtttctgtgttaacttttagaatcttcttatttatccctagttttgaaattgtataattacttccataggtgagaatctttctcttcagttgtgcagaattctcaatactcatttcctttcattctagatcattatgttacttctttgataattttctcctaacctcccatttttctattcttgctcctttctctgaaactccttgcagtcagataataggctgctcttctaagtttgattttagtattttctgtcctttccttcatctctttatcattttgttctttatggaacattttctcaaatccatcttccaacttgtcgactgtatttttattattttatcatatttttaatttctaagggctttccccctgtccccattcattttacatggagtcctgttcttgttttttagatataacatttacaactatattttagagggtattactgatagggtgtattgtcccctgcatttgttctgctgctacatttttgtctctttgctccagattgctttatctttctgttagtttctttttgcctttctcctttgtgttagacactttttcaaaagtgtggttctcccattcatatttaaaaagaaggtgagcaaaagctgtgggtgagggacaaggcttcattcaagagtgatgacagcgtgagcaggatttgtactgggaggccccacaagtcagtgtgtgaatgccttttctctttggaggtttgggttctcctccaaagaatgggagatgcctattctgggaaaagattcactgctgattactgagggctctgagatttattttcatgtttttggcctcctgttttgctgctgtatctggtatgtccaagcctggaatgacggtggttccattgattgtgagaatgaaccccatcttctggttcccatcaagaagtggataaagggcatggggctaaaggcctgccaccaaaactctgttttcattcccaccctcaccctgtctttggtgggtcctccatgctgagccaccaggggtctttggggcaaatgtcttcacttcccttcagtgcccccacagaggctccaagtgccacttcctccactttgctattccatcttctaaaactgggctaaaaacctcttgctcaccattgccatttcttgcattcccatgtccttgtggttaatacctttgaaatgtctgtactgccacgtttaaggaatggataagataaatcggcatggacaatctgccttgtttatcaagaagttttaaaaaaaatttttcggtacccaatacacaaaaggcacccaggaaacttcaaatgaataaattttagaattatcacaatttgaaatgctagccctagaaaaccctttaaggaaagcctgagacattcatattataaatgggagactgagactcaaatagcacccagcctctatgtgaacgcctctggtaacaaagctctcaattcctccagagaagcggctcataggcggaggtggctgtgtatcagaatggccgatgatacttttttttgtttttttgtttttttgttttttgagatggagtcttgctctgttgcccaggctggagtgtagtggcacgatcttggctcactgcaagctctacctcccagattcacgccattctcctgcctcagcctcccgagtagctggggttacaggctaccatgcccggctaattttttttttgcatttttagtagacatggggtttcaccatgttagccaggatgggcttgatctcctgactttgtgatccatctgccttggcctcccaaagtgctgggattacaggcgtgagccactgcacctggccgatgatactttttaaaaatccagatgctcaccgggtggatcacgcctgtaattccagcattttgggaggccgaggcaggtcgatcacctgaggtcaggagtttgagacaagcttggctaacatggtgaaaccccaactgtactaaaaatatgaaaaattagccaggcatggtggtgggtgcctgtaatcccagctactcgggaggctggagcaggagaatcgcttgaacatgggaggcagaggttgcagtgagccaagtttgcaccactacactccagcctgggcaacaagagtgaaactccatctcaaaaaaaaaaaaaaaaaaaaaaaaaaaaaatccagatgcttgagccctacctcagactttctgaataagaatccctagagaatgtccagtggggctcaaaaggttaatactgacccaaatctggaatctttgagagacagaggtgtccgcggcagcaaatccatacaggtctgcagcaacctcaattcttgcctcctcagaagaaaaaatttgacgaggggcataaggcagagggagagactgaggcaagagttagagcaggagtgaaagcttattaaaaagcgttacagcaggaatgaaaggaagtaaagtacacttggagagcaccaagggagcgacttgagagatcaagtgcacggtttgaactttgacttggagttttatatgttatgcttccagggggttgcgtctcctctccctgattcttccccttggattgggctgtttgcatgcacagtggcctgccagcacttaggaggggccgcacacgcggtgtgtttactgacgttgtgcacatgctgacttgaggcgtttttccctcaccagtcaaaagttcccagaggaaggccatataccaggtaaactctgccattttgcctcttcgtgcatatgcttgagcccactcgcccaactcctgagatcttgtcgggaagcttctgatcaccagttttaggtttttttctattgggagactgcctttcccaataattgccagctgtgaccaattattattttagagagacagtttaacaactgcctgaccatcacctgatggccacctgacattcctggtggagaatgcctgactacccactataacagaggcaggggtcagacactacctcttttactcatcaggggtcatggtaggtcctggctaggtgagcaggaagcaggtcttgtctgggccttgcaccctctacccaagggaacatttgggtctgtagagtctgtagacacccactcacccaaggccgctaccacacccagatccagaggaagagggagaaaaaggtctcaccccctgcatgtatggctccacatgccagccacctgccagtatagaccaatggctgtcacccagtaaccccataagtaactccatcgtgaagttagggcaaagcaggaggtcagtagtgtgtaggcaaagacttctttatgtagcccagaggagtggggagcaagggttgccccttcctgcccaatctaggtccaaacaaatatagtttcagacaagtcttccagtggggagccccatgtctgcggccaggccctttgggctgtgtgaaatggtaacagtgacagctgttgagtgagtgttactaagaactgggcattggctgggcacattggctcatgcctgtaatcccagcactttgggaggccaaggcaagtggatctcttgagccccggagtttgagactggcctgggcaacatggcaaaacctcatctctacaaaaaattagggctgggcgcagtggctcaagcctgtaatcccagcactttgggaggctgaggtgggtggatcacctgaggtcgggagtcagagaccagcctgaccaacaaggagaaaccctgtctctaccaaaaatacaaaatcagccgggcatggtggctcatgcctgtaatcccagctactagggaggctgaggctggagaattgcttgagcccaggaggtggaggttgtagtgagccaagatgttgccgttgcactccatcctgggcaacaaaagcaaaactccatctcaaacaaacaagcaaacaaacaaacaaaatttagctgggcacggtagtgcatgcctgccatcttagctgctcaggaggctgaggtgggagaaccacctgagcctgggaagtcaaggctgcagtgagccatgattgcacccctgtactccagcctgggtaacagagtgagaccctgtctcaaaaaacaaacaacaaacaaaaaacccccaaactgggcattaggctgagcactttgcatgtaatctattgaatccccagcacaaccagtaatgcaggttttattatctctattttattgataaggaaagtgaggctcatagaggttaaatttaaatttgaggtccaaaatgaccaagggagcaggcagtgcagtgaggagaggactcaaactcagatgggcaaggcaccagtgcccacatctgggcccacctggccctcagtggctccagctctttaagcaacagcatgtggctgagatttgagacaggcagatgatacagtgtgggacctctcgtcactgcccaacgatgttacctcaggagaagcactgactctctgggctttggttctctacctcctacccatggccaagaggcatagcgggttcagtgggtatttggaaaacagcacaagctaagcttgccccactttgcccagtttccagtcaggaatgaccaagatgcgaaccgaacctcctaaaagacttttaggatctgaagaattaaagtcacagaatttgtgaatcagagaaacttggatatagaacattaaaatcacaagtgtgtgattctaggacttttgcaaagcatcttacaatgcaagaattacagcttgttagagttataggacattcagatcacagaatctgtgaatagaaattgaccatagcagaaaatgacccgaccgcttctggaatgcagaaatctcttccaaaacagctctgacattgttatttctattatttatcaaacattgtatttggccattcttgcatggctgtaaacacctgactcacgccggtaatcccagcattctgggaagctgtggcaggcagatcgcttgaacccaggggtttgagaccagcctgggcaacatggtgaaatcccatctctacaaaaaatacagaaattagctggccttggtggtgcatgcctgtagtcctagctaccgggaggctaaggtgggaggagcctaggaggttggggctgcagtgagctgagattgcgtcactgcactacagcctgggagactgaatgagatcctgtctttaaaaaaaaaaaaaagacagatctgagacagggtaatttataaagaaaagaggtttaattggctcatggttctgcagactgtacatgcatggcactggcacctgctcagcttctggggaggcctccaggagcaggcacatcacctggcaaaagcagaagtaaggctggggaaggtgccacaaattttaaacaaccaaatcttgggagaactcattcaccatcatgaggacaacactaagccatgagggatccaaccccataacccaaacaccttccaccaagccccacctccaacatcggtgattataattcaacatgatatttggcagggacatatattctaattatgtcaagcacttataaagcccctactgcatgtgaggtcctcctctgtggactaaactttacggatgagcaaactgaggagtagaggggtgaagtggtttatctgttatctcacaatcagtaagtggcaggaccagggttcaggacccaacctcagaggtgggccaactccagagggcactctctttcttggcttctgtggcattgggagtcttatgagctgagccgtggcacatggaagccacagtgctttagcctctgccttccaggcagtcagcttaaccccactgctttgatacctactctaattctgcaaccattcatccaaacattaaatgaatcttttgtaaatttactgtccttttcagacaattttacttttcaagctttttaaagattccatatcaaaaactttcataccacctttttccattgagaataatgaggaacatttataaactttgacttctcacatctttattagcttattcttctagaaagaagtacatttcctttagacagaaaggacggttctcaaaaagccaaattcctaaagatgattactgttttttttttaaataaacttttctgattccatattgacattttgacatttactcctcaagccttcctaagtgggatatggcaattataattctttattatctgtacaaatttatggggtatgtgtgaaattttgttacacatatttgtgtggtgattgagtcggaatatttaaggtatccatcacctgaataaaatacatttttgttaactttagttatcctaccctgctatcaaacattggatttattcctttttatacccttcagcgtgcttctctttatctcaccccaccacccttctctgtctctgttatctatctttatacactctccacatccatatgatcaaattttttagcttccacatataagtgagagagaacatgcaatatttgtctttttgtgcctggcttatctcactttagttaatgccccccaattccatccacgttgctgtaaatgacatgatttcattctttttaatggctgaatagtattccatgatgtatatataccaaattttctttattcatccattgatggacacttaggttgattccatatctttactattgtgaatagtactgcaataaacatgtgagtacaggtatccctttgacgtatgaatttcttttcctttgagtagtacccagaggtgagattgctggattgaatattaattgtatttttagttttttgagaaatctccatactgttttctttcacagctatactagtttacgttcctatgaacagtgtttaagttttcctttttctctgcatccttgccagcatctgttattttttgtcatttaataatagccattttgacaggggtgagatgatatctcattgcggttttgatttccatttctctgatgattagtgatattgagcattttttcccataagattgcttgagaaccaagcaaggcagaggacatccaaaccctttgaaaaatagaaaatgttttaggaataggggaaggagcatttcttgaaagatgacccatgggggggctctatgtgggtgcttctctcacatccaattctcagaaccactttttatgtggtgagtgttgtagccttggaagttcatctcattattatttccaacagagaaaaatgagaggtaatcacaaaagcccatgttcttgagatacctgttattgttagtgttgaaatagaatcagagcatgaatgcacaccaaaaatagcaattctagaacaacatatttgctgcaatgaattgagccatcttactagctggcttgtactctgtggggtcaggtgtggagagggtgacattgaccctcatgcccaacaggtaaggttggtaaggcaaacacgaccagccacgtgctccccaccccaggattcagtaaagctgtggccagcagggtccttcccaggaggcggttgttgggagggatggtaaggtcaaagaagctccatgaacatttgctggctgtcactatttccctgtgaggccccactgctaaacaagcaggaagcattcaaagatgtaacaaagcaaccctatggaatgtgagtgcaggcttcactatcttgatgtttttgtaatagcatgagctattggagttgagcttgagtgatcactgatgagttctgtataggacctgccatagaggagtgtgacaggttcagcctgatagaatctgcatataaattccctattcagctagcagctgccaccatgagggaagggaaggtggcaaggcagcagtgctttgctccaagaactgcagatctgaggaataatgtcaaggaaagagccccgtgcagggatcagaagagccaggctcttgttctgccagaccccctaatttctcatgtgccttggcatgagttacctgacctttacaggtctacattttctcttatatggactagaaattataataatactttgtgggaaaatattatttataatactataaaacatcagccctctaataggacaacatataggacagttttagcatttttataaaaagtattttaagagcaggagtgtctgtcgtttcagggatttctgtatctagctggagcatctcttatctgtgctgtcattcatcctccccaacatgcattcagtaaacaggcatttactaaacacctgccttttacctggcactgggcagataaataaaggaacaaggcaatgggtggcccttcaggagctccgtctatagggaaacacacccataaaaagcacattgctatgcagaataacaagtgctttaatggaaattggtaccagatagagaagtcatccacgggagggaatgctataatgtaaaggatgagtagatagatgtgctgcagaaaggggttcttgctaaaatggcctaggagcgtcctttgctaaagctgtattttacagggaagtacacagatgggcctaggagaagtttcaatgggctgactaatgtttggccaagtaaataatttttgtcagatgtatggatggacatgaagatttggaatcatgggcccatagatgtgtcttaggttgagttccccagaaaagagaccctgagatggagatgtgggcaggaagctgattggagaatgagctcagatcagtgcctgcaggggaagagatgggaccaggattcagcagagggaaaaggtgagcaaccctcagcacaacagaggtctcagttgagcccacagggagctctggagctgggatggcccatcagagtgggataatttggaggtgggggaacagaactttatgcccccacatcagtcagccattggatgcagtttgttcttggggagggctgggtagccttggtggaggaaacatccttcaagggcaattccagaggacaggcccagctgtggtccacagccagtaatgctcccagcagctataagtcaagcttgtcagttctgggccatgcaccaccattcactgcaggtgacgcaggtgtgggggaagccctaggacagtggccgtcaaatagctctacattagagtcacctggagagcttgaacaaccccagcacctaagccgcacccccagaccaattaaccccaaatctctgagagtaaggaatgagtatcagtagtttgtaaaaactctccaagtgattccaatgggcagccaagttcaagaatcactacccgggggatgtgtgtgagatgaatgagaggagggcttgcctcaaaaccttggataagtatcccgagaagctggaggagaaccagggagagtgtgtcatggaaggtaaggggtgggggggtggtgtttagaaagaaataagtggccacctacagcaagaacatacatgcctgagtgggaggggcaaccagctgttctaaaatgtacccagaatttgtatgaatcctgtatggcgaggtgatggacatggaggcaaccttatctgaaagaagaatttattactcacagttccctagaggaggggacataccacgccatgcaggaccacgcagggaagcactgggtcagtcaggaggcagaaagagggaggggacagcctgcaccagagcctttattgtggccccatggcaggaatgagtgagcaggggaggcaggcttgagatcatgttgccaggctctgggctacagggctgttccctagttgtctgatacctggctctggagtggcctgtgggaggggaaatgttggctcagagtgtgagagtttgataaaggaagtgattggagtatagactttggattggtgggtttgcatacgaaaggcctgctctcaggcaggttgtttactagctctaggaattattaatagctagggagctgctattaataactgctcgggaaaggtcggtctctctgaaatcagaaaggtcatacaatatgaaagcgaaataaaatacagaacacataaaacatgattaatattaatacactaacctcatggccacctaggttggggtcagagtgggctggatttagcctcagcccacccccttatcagggagctgagtgctcggtgcacctttcacaaatatgcagagcagccttgaccctggatcccttgagctgcaatggagagagacagaaagagatgtacaccttgcagcagagacagagaaagagcacctgcaaacctgcaggctaggacaactgcaagggcaagtgggtggtcccaaggttgggacactccagaaccctcagaaagtgctcatgaggaaacaatatcagttttacacatccattggccccagagtcccaacgtacagcctcacacacttggttcctagaggggtcagacactggctagcaagcctggggaagaggggtaggaaggaggagagaaatagagaagtcaaccatctacctcccaccccagctctttccactgcaggcttctagcctaaagcaggcttggaggaaggggtatgggagatggaagaagtgtcagtcaatccattcaattcggttgattttgattattattttatactggcaattctgatgtctaaattgaaattgtgattctaggataggactctgctcagtttcagcagaaaagacatgagctcctagaatggggcagggaaataaagccccagggattaaattttagaggaataaggagacaaagatcaaggttgtatttagatgacattctggactgttcttatgtaacacaaggttacatttgtaacacacttagcagggagctgggcacgtggagcccacttgatcaatgtaagccattattagaataagagcctaaatatgaagaaatataaagaagagcatttcatttaatcccccaaatagctgtgtaaggtagggcttgctcttcccctttccaatccagcagcatggagcaatggccacttctggagcccttttgctgtcagaggcataagtggcccagccagcatcaaccccctcaccgtgctcccttgtctggggaccatgagcatattggaacatcctttataagaacttgacttggggtaagagtaatgatttcaactctacttaaacattttttgctgattcatcatagtccaggatgatattatttatggactaaagtagtctatagcttgggggaaatatgacctggaagtctatttaaaacatggaaacctgcagattaaagaacaagataatagagttattgcaaagcccattcgcctgacctgactgggagttaaaaatcaccttggccgacaagactatccttttctttcctcctgagtgaaatagcaggtgcaaagactctgcctgtgttctcctagatggacgctctagggctttaccaaacccagcaggctggaccgacaccacaaagactcatctttgaggttgtcgtttggtggcacctcatggtcttgtgtcaggcgagtaatatgcggttttttaaaacatgccttcctttttgaacagcatctgaaaaagacactcagaggccactgtctgaaaatggcaagggctgtttgtgaaagggaccagtgtgtaggaaagccctttcccacgctgatttgctccttcaatagacatgtattgaaccactactgtgtgctagcaggtctctgccttcaggccatgcccatctaatgtaaaacactgaggcctcagctctgtgttgggaccaagtgcccaggagctccatcaagggccactgagggtcttaggcctgggtcagatggtagaagttcagaccaagctctcctggcccttcccctgagtctggtggtctggtggctcctccctggtcactaggtatgtcttatcaggcctcctggatttgaattcagactctgggatcccagatttggcggccagtcatgcctctatgaccgagttgtggcctcaatgagctattgaacccctctgtgctgcagttaatatttctgtgtagtggagataatcacaggctctctgtctgcgagctattgtgaggatgagaagagatgaactatccaatgtgcttagtaataaaagccactctttcctgttgaacacctacagtgtgtgcaggcctgtgctcagcactcccgacatccattcatggactaaatcctcccaacagaaatcctccctaggaatacgtgttgtcactgtccccattttacagatgagaacactgaggcataggcatttcgataacttgcccacagcacagtgagtgggggtagaggcagaattcaaatccagacagcctgcaagagagctgtgcccatagccactcactaggttgccctgatcctggctgcaagcccctgctcagtaagggttgctgatggcgattacatctttaccactgtcattgggagagaagacgtgcatgttcattgtcagaaattcttccataaagcacagtgcatagcagagcctttattgtggccccacggcaggaatgagtgagcaggctaggcacttactcattgagatgacgtgtgcgcaggtcatcctagctatttttattatttgggtgggccacatgtataatatgggtggaaacacttcattcaacacacaccctacccacacacccagtcacacttttcttggtagaaggtgaggggaataatctctcctaactataacacctctccctgcagccagctaatatctccaggaaatctctgaacacttgctggaaaaagccaggttcagactcttctgctggctaagctcagtccctctggagtaaactcttatctgagctccactctggacactcccgaccctcaccttttccgctgttcaccccagggatgtgtgcagagtggccactgccattgtccttccccagttcagaaatgttggcatcccaatccgggggctgcccaccctgaggtttaaagaatccaccttttctccagaggtagaaagaagaccatagtcacccatgcgaccccccttaagaaagagtccacatgtccttgtatttaagagaccagggatcaaaggctatgccataaacttgataacagcctttcaggaataagtcatgcaatgtgaaacatacccactgactaagattccaaaaacactgaattgtagattcaaggaaatagagagtgtccatctcagctagtgcatagacccctcaaaggctcctgttgtcctcaagccaagtccaagagccatggaaaggcagcaaagccacccatgacctgacctctgctcaaggctccagcctcagctcccacatctccggcatcccctgaccttctgtttgcactacagttgttgttccccaatgagcctgggtggatcatgcctctgtgtggttatacatgctgttcctgtgctgggggtgcccttccacccagtggcagctccaaaaacaccacccctgggaagtgctcccactgtgacgatactgtgggaaaatattaggcttgatttccacctgtgtggctcctggctgggaggcctcagcacaggaatcgcctgccacacctttaacatgcagcagtattgctggctgtgtgtggggctggcggctgtgcggtggaaggagacagccatgggaagggctcacatcacatccggcacgtggtaggagcttcatggggttggttccctcgtgttttctcagattctgtttttacccttactgagacggcagccaaaccccgagagaaaataaaatcaacaccaccacacacaggcctagcgaaaattccacttctatgtatgttggggttttttcttcctggtctttctttttaatcaaactatgacacacatatcataaaattcatccttttaaagtatacagctcagtgggttttggtatcttcacggagtcgggccaccatcggccttccctaattccagggtatttgcatcaccctagatgaaaccccacacccatgcgcagtcactccccactcccctgtccctggccctcctgggcccccgacagccctagcctacccctcccagccttctagcgagagctcctcctgaaactggaaagctgacattggccttgccagttcctcaaagggcgatggaagggctatgctggctggcggaaccagaggagttttgtgaataaaaattgttattagatacagaaaagggaatcaaatctaaggcaccccttagatggagatgatgattggaccagctgctggctgtgtgcccctggcaggccacttccccactcactctgagccctggggccctgctgctctcccttcatgggatcctagaacttgcaaaagtctctgttaccatggacctcagtagggagcgagtcttgggagagcagcagagggaagccctgcctcccagcgggcagctgggggagaggtggggaggctgtccccaggccctgccagttctggtgccccaggatcctgagggtaccttcccatgggccccacctgaagccaacagaacctctgcctatcatgtgaagtcttttcaggtctgagtgtgtcttattttgcccttggccatctccttgtaccttcttgggaaataaacgtgtcaaggatgtggcattgaggacttggtttttcctccttctcatgatcagaactgcattgtgagcaggattctcttctttcagtggcacactgagagcctatttgtaaacttgggtaggaagaaagcaggttaggacgaatactaccttgatgggcatcgtaacgtgtgctctgggcttcatttaagctgcactgcaggggatgtcactgcttggagtgcatcacttgcctcttgaatagtgcgtgtcgtagggatctgtttgcctttcatagctggctggaaagtgaaaggcctcctctccctaaggggtaagctgtgccccactggccccctcttcctcactcccatggggtctgcaagagctccagctgcccttcttgtgtcctcactgagaagacagagatggttgaatgtcgtgggcgtctagatatctagcggtggtgcccatgtcacctccacatgcaggctccattcctggggcagcctgggaggcagccctggtgttgaagagaaggagaccctaagatcccccaggctcaccatggttccccagggagtggggtcaagcagcccttgagtggccttggccaaccagagccgcctgcttttcagagctaccttgcaggtcactatctcacaggggactcttgaggagtctctggactcatgcatggaaaatgctatatacgtgggactggtgcccagcctggctcagttccttccctcagcctttgttcctggggatcatgctgggcaggaagaccttctgcagggtcgaaaccacctggtccagtggcccagtcccctcaacaatgaccaaaggccactgcactcagcagcatctccttctcccacaggagagtacctggccatacctgtttggagtgattgtggtccctgccgttgtccagctgctgagccttccctttctcccggacagcccacgctacctgctcttggagaagcacaacgaggcaagagctgtgaaaggtgagggcccttccctttcctgcacagctccagcccctgcatagatcatcactgcaaggcatgctgggacctgggccaatgggcacaggaaggggtgttgtcattgttcctttttgcaggcactgggctgggtatcatagggtaccttctcatttcatcttcccaacagccttgctgggggacagagaggggacacagagtcacccagggagtctcccagggaatctggaaaagccagaacagacaagataagacgcaggttccctcacttctgtgcagtgtctcactaccacctctctagttgttcccagccacagagatgaagccatctgaaatttctgagtggcttaggtgcatggcggccctccttccacttcttctcccttcactgacttcctctgtcttaatatttacctgccaggagaggaaaagatgcaagcacagagtgaacaccagatcccaccaggcactggtctgagtgcttcttcacaatgacccacaggaccttgccaacagtccttcgagggaggaaggagtatacactcattttacaggggagaaaaataaggctcgcaaaggggcttgggagttgtctcatgtagctttctttaaatgccctaaatggggggatgctgagtcagattcaaatcttggctttcggaatcagagacatctctctacagagccctgaaaaggcaaaattatgttgcctagagatagacaatgcagaatgaacaatcacattctgattcttttagttttataaaatgagatgcagttgacagcaccatggttagttaggcatgtgaaggtaaccagcactaccttcacatccagctctgatgtctgaccttgagcaattttttaaacctttctgagccccagaaccctcatctgtaaaaaggaaatgacataaacttccctcatggggccattgtgaggactgaattagatggtgcgtataaggttcgtagtattatctgctatcattattactgagaactctgtgcattttagttctaaatttcatctatgtccaaatccaggaaaagacttgagaattatatatacaatttgtgcaacatcttttgaaattcacactacctaagtattttctgagttaacaaatggcataatgaaatattaacaattacctatatttgtctagcagtttatggatcagattcattttctcatttataacatttctctaaagtgaagtcagagaaggtaattgttattaccttcattttgcagatgaagaaactgaggcttacagggatgaattccgtttcccaaagctgtgggttttggtttatagagatttatagaggcttttgaaaatatgatggaaatgatagtgttttcttcaatacagtaaccatatacacaaaattctgcctatggcttggtgatagacctgggacttgagccctcttttctccagaggaccctggttagtaactcccacccccaatcttaaacccgttagtaaccaaaggattggaacccaaagaagattttcctccaacacccctcgtgcacagagagataccaggaaacggaagtagtggctattgtaccgggtgacttcccatgtggccagtgaggagaaaaaccacctaaaagtttggttcagatggttgtcagatggcagagtctctggagtaaaaagaaggtgactaagagagagaaccaaggggatctgattctagatgcacctgggctgtgcattattggaagagggtgaggcctccagctctgtctctactagcctgggagggtaacccgcaccccctctggctctcttgagaaatgcttcaattaagtacagttggaatgaatagtgcatgtcaatgccagacagtgaagaaggttttaaagttttatttcatagcacagtagggagtgagggagaagtacagttacaaaacgtgataaatattacatgtgcactctataaaaagaacaaagatattggccttaagttgaaatagcttattgaaattttcatctgtacctataaaagtgctaattttactccagacattcagcaagcaatggatatttagcatgttgggtgttctgccaggtgacagggtaagacagtggtatgagatgacattcctgccccccaggagtgagggagggtgaaggtctagttaagggagatggacagaaacacccactaatggctcatctgtattgaaaactatttcattctaagcacttcacatacattagctcattaaatcatcacaacaaccatagaaaataggtaatatttttattcccattttaagacctaaaaaaaaaaaccaaggatgggataacttggccaaggacataaagctagccaatgacagcactgaaatttgaattctgacagtctggctctggaacttatgaatgtaaacaaaatgcactttattacttagcaccatgctcggcactgtgggagataccccttctccagtctgttgataatttggggaaaagaggccctgtgttagtcaactattactgtaataatgctgcataacaaaacacccaaaacacattggctttagataatagcatgccccagttcacaaacctataggtcaacagtgttgttctgttaatcttagtagggcttgaccttaaaatctttcttggggccagctgaagttcactcgcatgtctgttggtcacctggctgacctaggttggccttagctctgttcaatgtacctcatccccagctggccagcagggcacattctcatggtaatcagagaggaaatggaaaacacaagcgttttctctaagcttgaaatctcctaaaatcctattggccaaagtaagtcacatagctaacccaaagtcagagtggaaggggcttcaaagttttagggtagaggacataaacgtagggaggccacgaacttgggccatcaacacaatcacttcagacaagaggcccctttcgggatgttcctatccccactccatccccacccccagttcatagtggcagggaatgagtcccaggccctgggtcttatttatttatgccacccttgtcagtttaggagaatcccagcctccagtgcctgcaatacacatggtgctttgcttctgtgatctccaaaactttgcagacaaggaaatgaccactcagaggctgagtagcttgcctaagataccacagatagttcatcacagaagcgagattctaactcagtttgtctcattcaaacctgaattcactgaagtgcagggtgctgccttgagcgtgtgtgtgactcttatttataagacataacgtgcacataaagacaaccataatagcaaaagatcggccaggcgcagtggctcacgcctgtaatcccagcactttgggaggccgaggtgggcagatcatgaggtcaggagatcgagaccatcctggctaacacggtgaaaccctgtttctactaaaaataaaaaaaattagccgggcgtgttggcaggcgcctgtagtcccagctactctggaggctgaggcaagagaatggcgtgaacctgggaggcagagcttacagtgagccaagatcacaccactgcactccagcctgggcaacagagtgagactccatctcaaaaaaaaaaaaaaaaaaaatagcaaaagatcattaatccatgggttggagacacagaaaatttctcctgaaatattatgactttatatattaagccagggttaaattccagatttgcatccatttcatctaagaacagttagataagtaatcgtgtatctgcttaaaactgaaaatgatatcccaatgccaatttaattcacttatttaacaaacaattatagatgattgtagcattatgaaggcatgcttaggacataatgttcgggggggaacaaagagaacataaaaagaatctgtgtgatcacagaagtgtggacatcatagatacgggcaggcccaggtaaatgcaggcacaaacggaggccgctgatgcttgagggagctgggctttgtgctttgtaggctcttgctgagggaggggcaacagaggtaaactcctcgcttactccctcacctgtgcaccaaacacacccaccaacaaccaacgcagaacccaggaaggaggccacggggtgatcagctggctcttcaggccctgctgtctgtggtggccttacctggaggccctcagctcacctatacccatctggagatggctgaggagagaagaggggctgtgtaacgttccatgcttgcccttgtcaatgataaagatgtccccatctcctaaaccgggcagagggagctgggcagagggaggtggggacgcactgcctcagaggtcttctctcggtctctgctggcagtcacctgctcccggaagaccagcgccctcctccctcactgttactctgtttcatttctaagatgtgagccaagataggtggcctctgagagtcttctcattttggcccatggactagctaagccccaggactcccttttccctggctagagagaacttgttgggacagggtgctgagtgaagaaacagaggcccacggagataaatgtctcctacagaaaacccaagggccaaaaaggggcgggaaaacacagctcggaaaccaccctaccaaagcctccagccctcagagcacgaagtcgttcctagaaattgcccacacacttcttcgttttaaagaacaagcaactcttgctgtaaggaccagcctcactttagatttagagaattgctgagggttttgctgaagcagaggatgttttctatgttgtgcctgtgatgggtgccattcccgtgcaacctttgagattgctggaggtctctgtgcccctgagagctgggaggaagttctcaacgtaccttcaattccacagcacagggaaggaagttcaacatttctttaccattcagagcatccctgtgctttgagtctcctctgcttcttggggaccagttctgttgctcttgggatgacatgatagtcccaacttgaaattcagtaccttctttggttttctcaaaaacaacagcacccatgtacaacaaatcaccagagagtttagagaccatatcaaagatttcagggtggtgggggagtcactccatcctgccactcacagcctcctctttcctctccctgtcatctctgctcatcatcccctctgctttcttagatgcccctggagccccgatttctcctccctctagcatgtcgagcgccttcccgccccttctgtagctggaaccagcacacatgcagacattcagcagacacctgctgctccagacattcatctaaatatttttcttagccatgacagtgcttgagaaacattctggtgtcagccgtgaagttgacacacttttcttcccctctttgtacctggtaatgttgctgctagtatcatcatgctccctggctctctggaaggcctactgtgtgtcacagcatgtggcccagggttagctgagagttagcagagctggggtccagccccgtcttccccataccacagctgtgtgactcaggaaagctgcccgttatctcaaaggctcagttttcttgcctgtgaatgcttatctctagggcccagagaaatgatcatatcagatcatggatatcagagtgctttgtaattctcttttataaaggcacgaatcctgttcgtaaggattctgcacccccgacctgatcacctccccaaaggccccacctcctgataccatcagtttggggattcattttcaactttttacttctggggggcacaaacattccacccatagcaatggtattttggcagaagggctccaatttctcgcaggaggcagcgtaagacaactgccccatctggggccctagggtgaagagctgccatgctaatgaggaaggagattcatagatgtgcctcccagatgtgcctggtgtgttcagacacaacagctcccaaaaatcccttaacccattcttcacaggctgggcatttcatgaaatggcagcagtgctcattttaatgttttatgagccacagagcttcctgcaggaaagagtggaatggaaactgttaagcccccagcgtgaggtcctgggacccatcaggtttgactgggtgcatctgcaggcgagacggtgctgggagcatatgttcaggggcacacgtcctaaaacaacatgcagcatctcctgggcttcctcaccaatgacttcttggacagcaatcttgttgagttcttccacatagcaggtgcagagagactgtgggatctgagtgttgacactgggcaggggtcaggagttctggtttggtcacaacacctctctgggctgtgtttctctacctgcaccatcagaagtagaacaagatgctctctaagaaccagctcagctccaggttctgaggtcagaaccagggcacatagggacagggactagtgtcaggcccaaggctcctggaagcaggtgttcgggctctgccaccacccataggctcccacagcaggtggttgtaagtgtcattgctccccctccgagggacagtgagacagcacagaatgagcactaagtgggctcaaaaccccccagtaagaaataggaacacttttacactgttggtgggaatgtaaattagttcaaccattgaggaaggcagtgtggtgattcctcaaggatctagaaccagaaataagatttgacccagcaatcccattactgggcatatacccaaaggaatataaatcattgtactgtaaagacacatgcatatatatgtttattgcagcactgtttacaatagcaaagacatggaaccaatccaaatgcccatcaatgatagactggatgaagaaaatatggtgcatatataccatggaatactatgtagccataaaaaggaattagatcatattctttgcagggacatggatgaagctgaaagctattgtcctcagcaaactaacacaggaacagaaaaccaaacaccgcatgctctcactcataagtgggagctgaacaatcagaacatatggacacagggaggggaacaacacacaccagggcctgtgggcagggggtgaggggagggagagcattaggacaaatagctaatgtatgcaggacttaaaacctagacgacaggttgataggtacagcaaaccgccatggcagatgtttatttatgtaacaaacctgtacattctgcacatgtatcctggaacttaaagtaaaataaaaattaaaaaattccccatggtaaatccagctctgctactaactggccatcatgcatctctccagatgactgtttcctcatctgctcatggctaggatagtgctggatggtaccaaagggcctttccagcaacaatcccagacctctgtcaggatggaaacttcctccaagaacagtgaggattcttgttctgccatcagacagtgtcttagggacatagctgttttgggacacaagaagcagggcaaagtagtttgagaaaaaatgaaaagccatctgtggtcaagaaagtgtccagctacccagggaagcatctgctccagtggtcccgatagacacatagtgtcttcatctacttggcatcatttctgtgcttacccaggtggagtggtacagtgggcagacaaagctgtgaattttgctttgtacaaagaggggatttgattgggagatctcatggcttcctttgtttgagttcctcttatatgctagtgtgggaggcagaataatgacctccaccccaccctgaaagatgtccacttccttcttcccagaacctgtgaatatgttaggttacatgatgaaggaattagggccacagatggaattaaggtcacagatggaattaaggctgctcatcagctgactttggaatgagtagtcctggactaccagggtaagcccaatgcaatcacaagggttcttataagtggaaaaaggaggcaaagagagagagaaccagagaagtggcaatctgagaaggagttggcccaaggttgctggcattgaagatggaggaatgggaccaggagccaaggagtgcaggtggaccataggagctggaaaagacaagcaggcggattctccctagagcctccagaaggaacacagccctgcaacactcaattttaatccagtgacacctgcttcagattctgacctccagaactggaagatgataaatctccattgtaatttgctgtagcagcaagaggaagtgaatagagctaggtacatggcaaccattaccttagtcctcacccccctaaagtctacacattttctaccttttgctttatagatgagaagactaagactcagcgaggaaatgtcaaggtcacagagctagtgcattggtcaatgttccacccaggaaagtggaaataatatttcagagaggcactggatgccaggaaatggttacagaggtgccagtagggctgggagagcaaaaggagttgggcagagtcaccctggagcccgtgcgttcaccctccctcccctttccaggagaaagggctcagtcccagctcagccactggcctgcccagtggcctcaaagtgctcacctctctgcaaaatgaaagagttgcattggcattggctcacttctaatttctgaagcctaaaagaagctcctctttgccgaggctgagttcagctactctcctccagtcacattccatttgtgtcaaactttgtcctcctttttgggccacaccatgcatatcccagattctgtggtcttacagagacagttttgatgccaggtgagtttgggttcaagaactgatcccatctcttactgacactgctggaagcatgactgtggcagcagggcagatgctggagctgctctcgttaacgtggctgatgttcttggcacagatgacgtgggaaccacagcctctgaggctaaccaggagccacagctgatagtgctggaactttgactagcagaagaggtcctttcttcctctaacgatgcatcagtgcctctcactgctggaatctaacaggactctgctagcatgggagtaaggagatatcatttatagggagtaaggacaggcagtttgtaggctgctagcccccatgacacagaagagttctaaaagggtggttgtggggctgagtcccaatagggcaaatgcaacaagttcataagtagtgggatgctgtcagcacatttcatctcagcacctgtgcactggctccttcgcctggaaggctctttccccagatgtctgcatgacccacacctccctcacttcctttaggtctctagtgaaatagcatcttctcaaaaacatctcccccagctgccatagctcagtgtcccctcttctcactgccacttaccttgatttatttttctttttagcacgcattatgacctgaaatgatatgtttataaatgaatttgcttagtatcactcccctccatgagaatgaaaagctccatgcgaggagggacacttttcctattttacttattgctgaaaccccagcacctagagcagtgcctggcatacagtaggcatttacttactaaataattgttgcatgaatgaagaaaaccaaagtataccaaaggctgagtacagtctgtagcacgctgctgcttaaagctctgtagtacattcttggaggtgtttatagcaatcggatggagacttacttgctgtgggaacatgaagcaatttcacccagaggagaagcaggcatggagaaagagagagagagtgccatttttacaagggaaatattttagatcattgctttgggccttctgtgatgtttctgtcttgatagtttctacctctgttctggagaggtttcctcatgagagagattttccaagtcaggcaaggcatatatatatatatatatatatatatatatatatagagagagagagagagagagagagagagagagagagagagagagagattgagagagagagagattgagagagagagagagagagagagagagagagtcattctcatttcaggtctccctgcagtcactctccatgtggcatcaagccccaccaactcaagtggtagtgagtcgtgtctgtctctcactagagacctcctgggagcagaacccgttccttgttcttcccttaacacagtggatctttgcacgccatcccagatgcacagcaagctctcacaagctgccggataatggcaatgagctgaatttggctccttagcctctcagccctgagatttcttgtgaggtgtgtggaaagaaagatcagacagatctaggtcagagcatgaactcctcactattacctgggcgaacactggcacatttcctcacctccctgaagctgtggactgaaacacactcgccttgaagggctgtttctgtaagacacctcgcacaaagcctggcatacagtaggtacacaataaaccttagcctcttctcccctgctcagtgtctcttgactcctcttgaataaagttgaatctgtaactggggcaagatctgattatgtaacagctccctctcccagcccaggagtttgccatgctacacagaggtttttttcccagttgggaaatgcaatttctcattcctctttcaagttctttggagttagtgattagaacatggctaggaatatgcatgaggtatgagccacaggaagccctcttactttcaaattgaagggagaatgtggggaacatgcattcagggggtagggcttggatgaactatttttaaatgacttggagagtgaagagaatgaactcctctgagagagttaccttccataaactcatgtaatttttaaatgggctgatagatagcaatttcccaggccatttcctctctctccaagggcagccagtttaaactggaggtatcagctctgtcccctcccaccccatgggtgacattgccccatctccttccaatcatctacacagcctgcacacatctggggttctgggcttgctttagagaccctgttgttcatcttcctctccagtgcctgggtctcttccacaatatgattgacaggtggtcaccaggctcctcttgcacaccttcagggatggggaactcactgtgcaaaaaacacgttcatccttggacacatccatcaggcagttcttccttgtggtcccacacatcagagctcttgcctggggcccttgttctgacctcagagccaaggaaagcaaatccaatccaggcatctcctcttgggaaactcttttctgcagactagacatctgcaaatatgagtaggttcattaccttcatccagcatgctgtgagcacctctgcattctagacccagaggaaaaccaacctcttccatgaagcatctgccatgagccttcccctagtgcaagcgctgccccgagctgacaggactgtgaggacaggagccagcacaggtgtggccacgtaccaatcacagcacacccccaacactgcactacaggcaattgcaagtttagcaccaattctgtgacatgttggaagcacagagaggactttctggctctccctcctaccctctttttcaccctgggcctgtgaggagctacatttccttccacccgtctttaggggaagacctggcatttgctaaacttgcaacacagatatccgtcttgctctgatgaaagtgatggtgaagggaaggttgggtgaaaaccagagagcatgatgagtgtctttcaatttcagatgagactgagagagagaggaggaaaggtggaagggaggaaggagaggggaggggagagagacaggcaggatttgcggggaggacagcattccaaagctctgaagggtctgattctaagttgctgtcatggtctgaatgtttgtgctcctcaccacccctaatttctatctggaagccccagctccccagagtgatggtctttggaggggagtctttgggagggctggctgaggtcatgagggtggtgcctccagagaagtgagaaggcagtgtctgcagccaggaagaggctttcaccagggagctgactctgcggacaccctggtctcgaacttctggcctccaggactgtgaagtctgttgtctaaaccacccatctgtagtatgatgttatagcagccccagctggctgagcttccaggaagcattgctggacattgggaaaatgatacttctggagccccggtgtgggttgtaattctcgctcctccgctcccctgctgaatgacagcactagccccttctagtgtccccctcacaccctccctctgcccactctaatttcagccttgctgcagcagacagtccatgtgggctcaggtatgggccaatgtttgcccaccttaagcacagcacgtgcctctccaaatgctcaggccctctccatggccaggaagctgctcagccatctgcagcgcagtgtagacattcagggagttaatacccctgggggcaggagctggcagataaatgccccatcttcccctgtgggacagttctggaggtattccatgtgctgctcagaagccccgcagaactgatgccctttgcccatagaagtctccccgagatgcaccttggactgccttgctctccagccggtaaacttcccacacccagcatgtgtctcaggctctgctgcgagggcatccagtgtcactgcccatgtgcaagcttcatcttctcacctgcaaagtgggaatactgactgtgtctacttcaggggatagttatacgagaattaaatgaataagggcacataaaacacaagggaacccttagcaagtggtgaccaatgttattgcaacgtggatagctcaaaaatgaacctcattaaacgatgtagctccaaacagaagcaggtgacaaggctggctgaacttgatgaagcggcttcaacctgtaatcccgtccatcaggaatgaaatgttttgggagttgaaaatgcaggccagtgaatttccatcttccttagtatcaaccactgtccttgctgagtagtaagaagttgttgcctttttatattttaacaataatcatttagcaaaacctactgaaacttttcattcggaatatgtttaaacagaaagttttttaaactgcttgcaagtttttctttttgaatgtgcagatccgagagttttttgtttgtttgtttgtttgtttgcttttgagaaggagtcttgctctgtcacccaggcgggagtgcagtgatgcactttcggctcactgcaacctccacctcccgggttcaagcgattctcctgcctcagcctcccgagtagctgggacaacaggcacccgccaccatgcccagctaatttttttgtatttttagtagagatggggtttcaccacgttggccaggctggtctcaaactcctgacctcgggtgatctgcctgccttggcctcccaaagtgctgggattacaggcgaaagccactgctcccagctgagatccaagagtttttattggtgatctgtgtatataactttgtctaccaaaccacatgacagacacatctctttttatggaacagtttcttataaaaggttgctactttctcactcctgttaaaatgtcatctttatcctgaagcaacagattgactacatcttgaatttgaaaatctctgtgaggcagcgtactgtcaatggtcattgaggctagcagcaggcttgcacctgaaatggagatagcgggttccactattgattgtcctgtctttctttgtgtgggagttgttagttttacctttaatttgtggtttcttttgttttgttttttttcttgagatgaggtctcactgtgttgctgaggctggcctcgaactcctgggctcaagaggtcctcccacctcagcctcccaaaaagattagttggaactacatacaggcatgtactactatgctcagcttttggggattctttacaagccacctgtatattcattggggttaattcaattgaaaccaaatactaccatttccaaatctgctaactggtaaattgcacaagtaaacagcaatatgtcattcaaaagacagatcgaaggcaccctgtcagcttctccacacggtggagccctgatccccagtcacataggccatgtgaaggctccaggttcggtccataataaaacgttataaagctataaataggagctccaatatctcctcctacaccccttgttacataccctaccttggatccaactgctgtcggtaataaaaacacactgaacctaagttaaaaacccaatgacttcctcctcttaaattccattagtcattgaaaaataaatgctttgatgaaatctcctatttttagaagcatgaggcctgccctgtgtaagggagaacaagctcagtgccactctgggcatggaacttatacgaggctattgccctatgctccacgtgaagtccctttgcctgtctcatcccaggcccccgatcacaagagggaagaggcctccgggttgttctgcgctttgctctagcaggaggtgataaaagaggtgacgaagtgtggctgctgccataacaaagtgccatgagttagtggcttacaacaatagaaatggggttgggcgtggtggctcacgcctgtaatcccagcactttgggaggccaacgcgggtggatcacctgaggtcaggagttcgagaccagcctgaccaacatggtgaaaccccatctctactaaatacaaaaaattagtcaggcgtggtggcggatgcctgtaatctcagctacttgggaggctgaggcagaagaatcacttgaatctgggaggcggaggttgcagtgagtggagactgcatcactgaactgcagtctgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaatacacatagtggctaccaagtaacaggaatccttctcatctctttatatgtattaacgttatttacttttaacaatagtcttctgaattaaatatactattaccatttctcttctaaagattagtaaactgaggcacagaaaagttgagtaacttgcctaaatcaccaagtaatgtccagagatgtttaaaaaaattattttgcccaatagagccccagtgggtctctgatcttagaacttgcacttttcccaccagctaacattgcctcttgtcataaattatgggactccgttatggcagatgctattatactcattttataaaaatataatagtttttttctctaaaccttctagatgaagaacactccaggaagatgccctgttgtcctattatggtttcaaatactccgggagaacctggctggattagcaagtcttagagccttctatcatctcaaaatccttcaggtttatcatttggctttaaattcttttttttttttttccaagatggggtttcactcttgttgcccaggctggagcacaatggcttgatctcggctcaccacaacttccacctcccgggttcaagtgattctcctgcctcagcctcctgagtagctgggattataggcatgcgccaccacgcccagctaatttttgtatttttagtagagacgggtttctccatgttggtcagctggtctcgaactcccgacctcagatgatccgcctgccttggcctcccaaagtgttaggattacaggcgtgagccactgcgcccggaccggctttaaattctttattacaaacagatcggccagttcaggtaatagcagcaatattcctttctttctgaccaattgtctcaccttaagtgccctcgagttcttctctctgctttgagagggttggtgagaatacatgacatgaagtctccaagtcctggcgtgactccaacaggccacgtgccacaagtcggaaagaccgaagttttttctttccttcttgttcttctttctttcctgcttctttttgaaagctcataggaaaaagggtctaaaagacatttgttctatctctgtggttttgtaaaaggtccatcttggaatgcagcttatttttagttaaggaaattcagagatcaattagttatatgttcgaagggtcaactccccagattagtcaaagcaacaagaaaggggataatggataaaatataaaactgccaaacagagaatctcagttgcctccactaggaaaggacttcccagaagatccactgcaacctcatccaggctttctccaaagcaggcagggcctctgaaacccaaatcctagatctgtactttattaattaagaacacaaataacaacaatgacaataataccatcagcattcctggagtggggcactaagtgcctggaactacactaagtacttcaatacgtagaacatcgtttattttatttatttatttatgtatttacttttgagatcgagttttgctaacgttgcccagacgggagtgcaatgggtgatctcggctcaccgcaacctccatctcctgggttcaagtggttctcccacctcagcctcccgagtagctgggattacaggtatatgccaccatgcccagctaattttgtattttcagtagagacagggtttctccatgttggtcaggctgctctcaaactcctgacctcaggtgatccgcccgcctcggcctcccaaagtgctgggattacaggtgtgagccaccgtgcccggcccatttaattttcacatcacccaacaagggaggccttactgctaagttgccacgccaggtgggaaagaggccaagactgtgaggtcaatggttgctgcagtggtccctgatttgtaccccctccctggatcgacatccttggggagttagtcctctctgacatttattctgcacgtggccatgggacttgcttgggccaaagggacaccagcaaacgtgcatgcaaagtgcttgcacattgtgcacattgggactttctcctttggctgctgttggaagcccaagaactttatgcaaggcagcccaggcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctcacctctccctgagacatttttattgttcatctcactcagctgaacaacctggtaccctcagcttttaagacatcgacaaggaagggaattagcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagcgtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctttaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttctggaaatggacaaaagttggaagctggaatcaactgccaatgtcatcactgggactggcaggaaactcagacaaacatgaaaaagctagtcttttctctctcctctagtgcccctattggcaaaggacaaatgggggtgcaggccccagccccagcatcagagagagagagcccagaagggtaagtgtggagctaggagacaacagcttgacaaccagcatagcgttctacaacttttgttggctccttccctccctccctccctttcttccttatttcctttcctttccagtggctcataaaataacaatactcctcagacccaatggcatcttagatttgatgaactacagtactaagtgaatggctggactaatcctctcaaacaagattagggaaatttccatggcaataattattattaacagctctgtgtcaggactgccatcacttttataaacacatgcctaagacctcatggttcaaatacctgacttgtttggaggcctggggacctggattcctgcaccagctctatccttcaggagctaggagactttgaacttcatttctctgtgttttcttttcctcacttttgcaaaatgatcctaaaagcccacatttattgaactcttgctataggatagaccctgctttaagtactttgcattagtagctcatttaatcctcagaatgacccaaagagataggtactcttataatctctattttataaacaagttaactaggttgctggcaagctagaaacttgttttatttttaatttttatttttgagacagagtcttgctctatcacccaggctggagtggattggcacaatctctgctcactgcagtttccacttcccaggttcaagtgattctcctccctcagcttcctgggtagctgggattacaggcatgcaccaccacacccagctaatttttgtatttttagtagagacggggtttcaccatgttggccaggatggtctcaaacttctgacctcaggtgatctgcctgcctcagcctcccaaagtgctgggattacaggcgtgagccactgcgtccggcctagaaacttgttttaggtcatatagtcagtgagtcaaggagttggggaaacatcttagccctttacggcttattttttttcctatagactcaatgagttaacagatattaaattgttttgtaaattgtggttaaaaaattattttgcccaatagagccccagtgggtctctgatcttagaacttgcgctcttcccaccagctaacattgcctcttgtcataaattatgggactcagttatggcagatgctattatactcattatataaaaatataagtttttttctctaaaccagcctctcgggagactggggcaggagaactgcttgaacccaggaggcagagattgcagtgagccaagatcatgccaccgcactccaacctgggtgacagagcgagactccgtcttgaaaaaaaaagaaaagaaaaagaaagaaagaaacatcagtgaggccagcctggctggaggcagtagggagccagggagcaagcagtagaaagtgaaagttgagaagagaaaagaagaactcagagagtcttctatgccaccataagaactagcgtttcccccctgggggagatagcagccactgggagattccaaggagaggaatgacaccggctaatacttgaacaagatcactacatcttgtcttctctgttgctcctggactgcaggggacaagtgtgaaagcagggagaccagctggggagctaccacaacaggtgagtcaaccactggtaatgatttggaccaggctgggagcagtgcacttagtgagaagtggtcagatcctagcatattttgaagagtgagttggtgggatttgctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcactgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaacctatggaaataatgtatctctccacagacctttccagtaaatcttcagcctgactgggcctataagccaagatcatgccttgtttccacatccctcaccctcctcgtgttcatccgttcctgcatacccagcttgaattccttggctcatccctttaaatatttatatgcccatccaccccctttcattacatatgcctggcaaaaccccagctggttaaatctctgtctactgggcatctacaaagctcagcttggctggagaaaaacatatggctgtgttgtcctttctcacctgaaattcatgaccaccaacctcaagaagggttaaggctcccctgcactgagtctacagattcctggtccatccaacacccttctctcctagaggactatttcatatgttttctctctctcttcaaatcccctttttatcattctcagctgatgaccatgctttctttttcactgagaacacagaggcaatcccaagagacccttcccacatgccctctgcttgtatttctgcacctgcatctgtgcccagacacctgccttcccttgttttccaaccctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctctgcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactcaacagatatgtggtgagtaaataatcggatgagggaacggaaagtgtgcaagcatacaaggatgcttagatgcaagcaaggatggccacactggggagatgtgatagaaaaattcaagcatcgagcattttccacccatccttccatttatccaacaaatgtctactgcttgcctgctgtgtacaagctgctgtgttgggtgctaggggccataaatacatatggttcttacgttgaagggctcccttatcagggaagagacgggaacataatgaaatgagtacaacccaaaatgccaagtgacgtaacacagggaactgaaagtcctgtgtgagctcagagaaggccaatatttagttctggtagatatgtcctaggcagtgggggatggggttgaagatttcttatgatttctaaccctgctttcccggctcatgcgtctgtaataccaaaggggttgtgtccataataaaacaaaccagtgatgcagggacagcttgtaccattgaagcctcttgttttggatgtgttgactctttgttttacactttggaaccctgccgtcccgaagtcttctggtcttatctaccatgcccaggctttctccttatgtcccatcatgaacccaagtttccttcttccagagttcttgccattctcactatgcttagaagactagtcaagtcttctaaggctgggagaagcagggttgaggatcaggtttcctggctggctggttatctccctatcccctcagggattcccccagctcaatgaatgctggcttctaaaggctcagggttgactcttctccagaagattgacattggctctgaaggtggatccccctttcccagtgctgcctgcagcgagtgacagatgagtggtaggggtggatgcagcccccttacttcaagttgggtgactctgtggtgtgattatgccccagagctcccccaagtgaggctaaacttgaccagggagtgcagccttgcctggctccttcccctgctgctttctgctttccccaccttaaagattactcctgaagagcccttcctccacaagccatgtgtgcatcccaatccctgcctcaggctctgcttctgggcaattgactttctgagacaattccagcctgaaagaagaggttgtcagcagcacggtgtgttgctcagtcatggactaaactatgttcctgccccctggttgagaacccttgaacgcatgtaacctcgctcgggccaaggagattcatgcctgggactttaactacaatgattggaaggagaatttccatcaagctggggccatcttgcacctccacagaagaaactgcctgacaatgaagccaacaaaaaacaagctgagctgagaggtggagaaagagagagatttggatttttttaaggctcacctgttaaagccctaacccctaatgtgactgcatttggggacagggcctttaaagagataattaaactaaaatgaggtcacaaggaagcggccctaatgtgggatgattggtgtccttgtaagaagaggaagggacaccagggatgcacacacacagggagcacacagcgagaaagcagccatctgcaagccatggagagaagcctcgggaggaaaagacctgccgacactttgatcttggccttccagcctccagaactgtgagaaaatgaatgtctgtttgctgaagccactccatctgtggtattctgatatggcagcctgggctaaccaatgcatgcttgccacatacactgaaggctcctccagcaggcacctagagagacacagttattttctactactataaaatacagatgccttttaaagggttgaagtagaaaatgatgaaagcaaaaatagtccttttgacaacctgctatttccctggagtgatgtatgggatgcctgttgtttgtgctcaccgaacctccatccttcttctgggaggagttcctcaaatttccaccaagaaaccttcctgcctgtctccacctaaccatggcttcaggagtggatgcgtggtacaggcctggccagtcaacataaaatcactcatcattctcaaggcatttaagatgtgcttttttaaaagcacttaatccagagtgttagaatgttatttgccaggattttctaaccttggcactattcacatttggaactggaaaattctttgctgtgggggttgtcccgtgcattgtaggatatttagaggcatccctggcttctcctagatgctagtagcacccttgagttatgaaaaccagaaacatctcctggcattgtcaaatgtcccctgatgaggcaacattgccctctggttgagaacccttgaacgcatgcaacctcgctcaagtcaaagagattcatgcctgggactttaatcacaactatcggaaggagaatttccaccaagctgggcccatcttatacctccatgggagagattgcctgacaatggagccaacacaaagcaaggtgagctgagaggtggagacagatttggattttttaaaagctatcatctgagccactggattcaaccaagttatattttagttattgtgagccaagtaattcccttttgggcttcagccagtttgctttgggttcctgtcacaggcattcaaaaagcctccttagtgacatgagacactgtaaatttgatctcgttccaccctcatagctgctccctcaggtgggtttgtttatctgcactttacagatttaaaaattaaagggcatagcagctgcctcttgtatctctaccatccatgcacagcactgctcagaatcataaagacttacataatgaattactcaggggctgcctcctttgcccaagcatcaccttaagccccagatgttgtgtctttcttgttcactgaagccccagtgccaaaaacagtaccttactccttgtaggtgctcaaaaatgtttgtttggatagatgaatatggttacgtggcttgtccaagagtctggcccaggatcagatttcaaagcccatgtgtgttttcctatagtttcttatatgttttttctgctttgctccagacggaagaaccagatccaatgatatgtgtaagaagaataatttcagtgcaattgaaagaacagatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgaccactgggtcttggactcatcatttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggtattttcaaagttgttttctcttttgctttccttttccttttttttttttttttttgttgccatgccagtgagggtagtaaagctactttcattgccctcattttataggtaagaataatgctggctgagaagtgaggtgtcaaagtcccttgtaacacacctgatacacagcagagtcaggacttgctgagccacggcattctgacccgattctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcccctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtatttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagctgattggagagggcctgggtaggaaaggctgatatgaagtttttgattctcactgcttccttatttgtaatgtaaatgatctgaaatgacctaaatgtctctcagtcagggagtgtggctaaataaatgatgagacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctcctcccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcaaagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaagatgttaatctttattatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctatctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagcccgcaaacctcagctgagccagtatatgacactgcagaaaaagcttaggttcaggtcgctcagacctgggctcaaatcccagcacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtaggagtttgacttgtacagccatcttggaaaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccaaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttctttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccagaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggatgaagttggaggggcaagaaagggcaggtcatgtgggcctgataggtcatggaagttagcctggtttttacttggattctactctagatgaagtgggaaagtattggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaatggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatgcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagccaaaaaccacgaagtcattcttaactcctgcccttgatccaatctcctcaactaatccaccctcactcatccctgactgttagggttgaattgtatctaacctcacacctccagatttatatactaaagtcctaactccccaaacctcagaatgggtccttatttgaaatgtggtcattgcagatataattaattaagaagaggtcatattggagtaaggcccactctactccaatatgactggtgtcctttatagaaagaggacacaaagacagacacgggtacagagtgaattttgttcccctccaaacttcatatgttgaagtcctaacccctagtacctcagaatgtgaccttatttggagacaatctttacaaagcaaataacattaaaatgaggtcactagagtgggccctaatccaacgtgactggtaccctgataaaaaggggaaatgtggagatagacaggcacaggaggaagatgatgtaaacaggcatggggagaagatggccatctgtgagccagagagagaaggctggaactgagccttccttcaaagccctcagaaggaatccactctgccaacaccttgatcttggacttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggctttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggtttgggggcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaaacaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccacagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctgaatggcttcatggagcagagtgttcctgctcatctccttcaaatgaggtgatataaatgggaattttcactgtgttaagccactgagatacagggcttgtttattacagcagcaagtttgccctgctgacacaatcaacgtaactacagagcccatgccatcacaattgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctgcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactacagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagcccgtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccaccccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttgggtgaccccagtacacctcccttgtcctaaggaaaaaactcagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagttgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgcaacatcaattctggaataactcatttatagaatgggaataagaacccctagcttgtagatgaggccgccagaaggatgaaatgaggtgtgtgaagtcccgagcatgatgtcagcatacagcaggtgctcaataaatttcagggtcttcccctatgggtcagaaatagggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcggggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataaatagtaagccaaaaaagagagtattaaacagtatatatgatgatcttcagaaaaaagagtggatttagatgacacattaaaagcggcctctggatggagtctgggttttgactgtgttcaggcccaagtgtaccatctattagctaggtagccttaggccagtcactcaatctctcccttatttgtaatacagggttatcagcataaatctgccatgtggggctggtatacaaatgagagagatcatctctcactcacagaagaatgtttgtatgtgtagcttcattatcaaatttctgtgcggtggtttttttttttttttttcctaatggaagtctgttgcttttatagttactgagataaagtgagacaaaagcaagagtaaaactgaaaagagcggggggtgaggggacaaaactctgggattcagagatacccatttcatagacataattgcccgttgtttctgcagtgacacaatgcacagggtcctcctgtaatctcagccctcttccaccaaagtcttgagccctgctatgcctccccctcaccccaaccagaacttatgtcgtttgacacagtctctgctcatcattccctcctggtttccttgagaatgggtctcaggccacaccagaggcacctgccaggcgacatgcttctttctctaagagcgcctgggttcccagagcagcctgctaagatggcattatggggtgggattaactgaaagcaccagaacttgcttttgggttctctctctgttggttcacttgaatcttgtttgatcaggttctaacatctgtggctaactgggcagctctacccttatagagggaaatgttgattttgctttttattatcatttgtttatctgcctttagggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataagtcctaatttatattggatggtgtggggccaatgagttagactcctaaagttaagttctcattcattctttctcactccttccttctctcactcactaattcattttacaaacattttttgagtattttctgtttataatatgcatttgtgtaatgtaaatcttatatacacagtagacaactgtataataaagtttggctggcctttgtccctggttcttgggatgtagcctgtgaattcttgggatttcttgagttattcatggcagacctctcagaatcccttgatagtgtatgttaacaagataactcaggatgggggttggccatgcaagaaagaccagccatgtgatagagggttggggctttgagccaagtgacatcagccctacctccagggaagagaggaggaccaaagattgagttcaaccttatggccaatgatttgatcaatcacatctacatgatgaaaccccaataaaaatttggaacactgaagcttgggtgagcttccctggtagacaacactctgtgggaggagagagaacaccagagctggaatccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttctcatggatcagctactcttgaacccctcaccctttggcttgttttttgtcttggttgggcccttttggactgaagtctgggctccatactgtcggccctgccacagaccttgcatttctttagaacattgcttccagaatcttcctgtaggctctgtggacaacacccatgagcaagaggagctttgactcatgctttgcccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggatactcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggtagtgttaaataccatgaggagaaataaattcggtgagggctaaagcgtgatggaggggtgccattttggataggctggtcagggaagacatttctgaggaggggacgtctgagcagaggcaagaagtaatcaaaggagagtgcacaggaaaatcaagggaagagcactgcagccagcaggagcagcacgcacaaaggctctgaggttccagcgtgcggtgtgtttgaggggcagcaagtggggagaagtttgtgtaaatggagaagagggagtgaggggggaaatgatgatgacagagtggtcacatctgtcatgtgtcatgtgtcacggccccaggtaccgtgtaagtcaccacagtctggcttgctttctagatatagtgggttttgagcggagggacaatatgatcttgcttcatttgtcaaggatccctttggcctttgggtggagactaaactgtaggaaccagagtggaaacagagaaaccagttagggtttagtgtagagaatgaatagagcctagctactgtggtgttcatcttggtgatcaacgcaccagcacagcacagataaccctgattttcaacagctaaggacaataagaacctcttgccagttcatgcaaagtccagtgtgcgtttaatagttctctgccatctgggggaagaaaggactgaagatctttcttcagtgctgccataaccagggatgctgccataaaccaggcctcatgtggcctatcagcacctctgttcacatcccatccaccaagctggccaaggacccttgtggatgcacgaggtgcaggtgttctcttccaaatgaggcatgaaaagtagtcagatcctggggattcttggaaagttgggtggccaggaggcacatccaggtgactgtgttgaggagaagccagtgggaatgtttaggaagtgtcccacccctgaaacttggatgtattgggttccctcagcctcagtttcctcgcctttaaaagggggttagtgatagctgccttgcaatattataacaaggatccagtgtgcacacaattctgaacctgggtcaagtgcagagctggtgcccagaggcgagttattttcattttcggcattacagaaagtttccaaatatctgaggagagaggagcactgagcgtttttaaggttgaggctgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgtctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgcctttattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccctaaccccgatgtgatggtatttggagatgaggcctttgggaggttactggggttagcagaggtcatgggggcggcctcatggtgggatgagtatcttgctcccttgcactcttcctccctctgccatgtacaggcagtgagaaagaggccgtctgcaagccagaaggaaggtccttgccagacaacgaatccaccggcactttgattttggatttccaggttggagaagtatgggaaaataaatgtcttgctgaagaccccaggctgtgctgttttgttacagccaaagacactgacgtctctgtatttctgagaatggaatgcgcctggcatgcagtacattttggcagagttgatgagctggccatcacagtctctgctcctcttcaaaggcagagagcacatgctgggaagtagctacccaactggggatgacacttcccaggccgtggatctgggcagatggctcagtcctggactcaaggcctcctcggggtgcttgctctgggctcctctaaagtatgcatgacgagccgtggtctcgaggttcaaaggacaccaggctaaaaagcgccttgtgatgtctcaagactgaacaccttgctgcgcatactggccacagaggtagagctccgatatcccaaacaagaagtcccatggcctaacactgcctggcacagaaaggatctgttttaaaaatgactgaaaatgtgtctgatgcctgggaaaccagaagcccgcccagggccaaactctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcactcatcttaagaacggtaaaggccaccctggctgtgtagatcttcagaaatctcctttcccgaaacggagggagggcacgttaaactctctctgtttggcttaccatggtctttcccattaaatacctctaagctctggcccctcctgtccttctcactgacaccaaagttgtttttctaaaaaacagtgagcatattaaataagtaaataaataaggaggcacgtgttctcaggacctcctgagggtgtgtcatggttaaagaaaaataaattttaattaaaaaaatgtgagttgcaaacccccacccccatgaatctgccatggctccctactgcccaagactaaaatcctactcctcagcctaagatcttaggccctcttcttttgactccatcctgcttttccacctcttctttcatcccagctctgcattccccctaggtactggcacatcacacgctactaacttcctaatatgccaccatgtgggcacagccaggcctctgtgtgtgtgcttcagctccccacctccctttgacacctgtggaaattctacacatccctcatgactcagctcaaataccacctcctccaggctgtcttccctgatccccagagttggatacattataaactctcaacaatgcttgctgaatgaataagtgagtaatgggattcctccgtcctcatgttcccatagtcagtgcttgaacccatatcattctatcccaggtgtaagtttcacataactctgctccacaagccatgagtgcaaaggttctcccccacctctcacctggatgttttgatgaactttcaagatgaagcaagagtccaaattcctagccctctttcaaagacaaatatcgacaagccagatccccatcttggaatgacgtcacaatgacaaaatcaaagatcactgactgttggcagtgcttactgaagccatctaggccccctggttttcaaacagtttttagcaacagaaatgaacaatgtcaaataattaacagactttttaaacatagaactgacctgcgcaaatagtgcttagatccgtgaggcacctctgcaaaattccagggctcatgggaacctttgaaactcactgacccaggcttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtggtgcatgcctgtagccccagttactcgggaggctgaggcagaagaatcacttgaacgtgggaggcggcggttgcagtgagccgagatcgcaccactgcactccagcctggtgacagagtgagactccatctcaaagatgatagatagatagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactccaagcgctatcagccaggcgtgattctaagcacttttctgcgcattgtctctgagtccttagatcagtgctgttatgtcctgtattacaggtgaggaaagaggggcagggagcgtggctggtgctgtctaggatggggactgaagtccaggtggcctggctgcagtgcccctctagtcaccactgcactgtcccctgctgacccgtcacctgagtgccgttgtccaagggcctgagactgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatacaggccaagtggacaggggccaggtgctccggaaggcaccttctttgccatcatttgacatatttgtgagtgtgtgtgtgtgtgtgtgtgtgtgtgtgtgtgttgtaggcgccaggccctgacaaagctgtgggggtgcaacagtgaagaagacatatggatccatggttcagggacccatatcagtcaaatcccgtctggaagggaatgcgggtctcttgatggccacttacctgctctgccagtctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgctgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctcagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttccgtgagtgaggaggcagagtccactggaaggagggcgggagttcctgacaggaagtgtggcaatttgatcatgcctgaacaggcaacggggcaacatttttttctctgctcctaagttattacagcaatgaaacagtccaaaaagggaaatctgtcctctccaggattgccacccagggggtggaattttttttttttttcttagcatctttttatttttctctggtaacaaagcctggagcagggtgactgccattaacctaggatacctccctaatgcttggaacagaatggagaggtggctgactttgactcagaagcctgcatacagctctgcccctgactcttccactttttttttttttttttgaccgaatcttgctctgttgcccgggctggagtgcactgatgcaatctctgctcactgcaacctccgcacctgggttcaagcaattctcctgcctcagcctcccaagtagctggaactataggcgtgtgccaccacgcctggctgatttttgtatttttagtagagactgtgtttcaccatgttggccaggctggtcttgacctccttacctcaggtgatctgcccacctcagcctcccaaagtgctggaattagaggcgtaagccaccatgtctggccaactcctccactttttaactgtgtgtcctcaggcaagtcactttattctctgagctgcaacttctaccactgcaaaatggaatattgaccccactctgactgtcctgcagacttattctgaagctcaaatagaaaacagccagccccaagtggcgtgctgtaaatgagtgtgggctctcctgtagcctagaacaaaggcgagggctgtgggtttggaagaaaaagaatttgcctcttagtcgttactctgtcctgctcattcagcactggctgaggggacatgtcctgtattccagccccaggctggctcaaggacagtactgagaaggcaagggcctcatgcacaccaggaggttgtgggaatcagttcatcacatggccatgttgcctcagacgccagagaagcaccttcaattttggctagaacagtttgctcccagaagcagagagcagtgcagagtctgggccagagccagggacaggcttggtgaatgcagaacgtccaggaggcaaggtagggctcagtccacaaaagagagatcgaaaagttagcaaagtacgtttagtaaaaagcacacaataaaataaaaggtgtggagtacggcagacattccaggaacctggaatgtgaaacgcacgtggaaacgtccggccctgacatgcacggtggtgggaatgtggctgctcaaagcaagtggggaatcaagacttccaaagaggaaaaccaccctcaggagttaggttggggatgtattgagcacgccagtcattcagtgcaatcgtccttctgtgtgttaatcagtcaggcatgccccgggagaagtggctgtttcttgaactggatttcagctatgcagcctggtttcctcattgagtggtgggcctagagcagcattctgatgtgcaaatccttaattataacatgacctaaaaaggcggaggattccccaggacagtgtggaggaggcaccacatcaatctcagctggatcttggagaccccgctggaagaggcggcttctgagcggacagagaaggatacggggtgagaggacaaggagccaaggcctgcaggcacagatgcctgcagtgtgtgggaggaagtgaaattgtcagtgaagcatggttggggcctgaagtacaggagatgggcagaggaggggcagggacagctgcatccctgtgcatggagggcccctctgcccctatgctgtcctgatagggactgcattttcatcatctcatttacccctcctcatcccattgctgtgactcccctctctataccctccctgtttcctcatctgtaacagtggggacctcaccagattttgctaaagctcaaattggatcaggtgtcccctcatcccgttaaaaattgcttcgtagtcctctgttgggtttgaaaactcaaaaggaaccagaaattaggcagtggacatgaatgtgcagctacagctggacagaaagtaaaagagcggagatgggtccctcccggatccagatggtagctaaccagggttcctggtagccacagcacttgcctcaccttcagctcctactacatgtgcacagctcatgttacatgtgcacagggctttcccaagtgtgttcaccttcatgatatcgtttagtcctcagaggaactatcagacctacatttcggggcaactgaagttcagggggagcatggaggagcctgcctccaaagcgagggctggttccccattccacagggccatcggccctgcactgcaggcaactgctaaggaagcgactcctatcacagatgaagtcataagacaaacatccccagatgttctgggctggggcacgttctgcctgctctgacactcactggttccttcattcagtcattacttgcctgtctttatgaagctcctactcattcaggttctcctgaccttgctcaggccctcacttctgactgccctgaactgtgctcacccttcagcacttaactctctcgccacctcctcccagcagcctccccaacctctcgctgcctctgtgctccatgtgtgccttcccctctgcacgtgtgctgctgctcacgtgtgccttcccctctgcacgggagctcactgtgggcagggatggtgtgcgtctcaatgggctgattgtgtcccctcagattcacatgttgaagtcctcaccccaagtacctgacaatgtgactgtatttggagatagggtttttgaagaggtaattaaggttaaatgaagtcatatgcatggggctgtattccagtatgcctggtgtccttataggaagaggaaatgaggacacagacacacacagagggatgaccacgtgaggacgcagggagaaggcagccacttctgccaagaagggaggcttcagaaggaactaacctgctgacactctgagcttggacttctggtttctaagactgtgagacaatacatttctgttgtttaagctgcccagtctatgggactttgtcttggcagccccagcaaacccacagtgtcctaagcctctttgtattcctagacttccttcagcctggctcagggacagggtccagtagataggcatcacttctggaactgaccttaaactgtcctccggatgatttcctaaggctaaaaagttgtcttggacaaggtggaagttttctagcagggaagagttggaaaagaaggggggttttctattgagtatcatttaagcagaatgtttgaaatgactacatcccttccttcattacaccaaatacttagacagtagatccttgactcacctaatgtaagcaccaagaaaagatatagcgtccacttagagggaactgctgtctatttgacattattcttgcgtggggtcttgggtaacctcaaacaggtgactgcacccttatcctccatttcacacctctgtggggacaatgatgttcagcttgccaatttcacaccttcttgacaacttggtaaatggacttgtgttgatctctgtcctaccaaatacaggtttattataaatacaaataaattttccctggagtcacagtagcttccacacccatcacaggaggtgaggcacagataatccaaggtttaagaagggctcaaacctgtactagccacatagccttggacaagtggcttcatccctttctgagcctcagttcatcgcctgtaaaatagggccagtgatgccttcagcatggtttgatccagagagaaccatgtaaagagtctctctttaaatgagagccctatgtaaaggtccagcacagagtaggcactctctggctgttggttcttgaatcaggtttaaaaagagcatctgatgagtcccaagaagaaagaaagtcattctattaataggagctgaggacttcctggaggaaggggcaggtcgactaagctttgtgatggattaaggggtgggttttagtgtatctttaacgatgatgacataatcattgtcaacatcaatgtccccttgttgagaaatgacctttgtaatggagacttttgccccaagcccagaaagtcaccagcagatcaggactgtcaatttcactcttctgagcctcatcccagacactctacaatccccatggctccttcccatagaacttggctttcagctgctgctcactcttttctctgcccagcttcaccttaacagcctcccactgacccaggggaaaggggtactaccccctgggtgaccggaataatcatgtaagggagacagaaaaaaaaaaggactgaccaatttctttttcgctgaatcactttcttcatcttctcctcggtcctttttactgagcttcatggttcacttttcaggttttgaacttttgttgttattgtttctgagaaagagaaaaagaaagaagccattagacagctgctttctcagatgtgcaagtcaggggaggtggcctggagcagtcttcgaaaggtttgctgtgaggagctctggctgggatgccaggataggacacagcagcatcctcgcttgggcatctccctgctctcctctgtcctcagtttctctatttttgagtgcagggcttcccacacttgccttgttgattattaaatacaggcaatgatcccattcctcttctgcatcatcaatttatctctctgtgttggatctccccgggctatgtacaaaaatgtcctagtgtcacccatattttttttttaaaaatcaactaaaagtttttggcaaggatgtggagaaattggaacccttgtataggattgtctttgctagtggaaatgtgaaatggtttagctactgtgggaaaaagtttgcttgtttctctaaacataaaatcaccacatgacccagcaattccaccaccacatcgatgcccaagaggactgaaagcagctgctcaaagaaaaacttgtgcacgaatgttcacagcaatgatattccaatggccgagaggtggaaacagcccaagtgtcctccaatgaatgaatgaataagcaaaatgtggtctatccatatagcggaaaattactcagcaataaacagaagtgaagcgctgatacaggctacaacatgaatgcaccttgaaaacattctgccaagtgaaagaacccagacacaggccgggcatggtggctcatgcctgtaatcccagcacgtggggaggccgaggcgggtggatcacctgaggttgggagttcaagaccagcctggccaacatggtgaaaccctgtctctactaaaaatagaaaaattagccgggtgtgctagcaggcacctgtaatcccagctactcgggaggctgaggcaggagaattgcttgaacccaggaggcagaggttgcagtgggctgagatctcgccactgcactccagcctggtcaacagagtgaaactctgtctcaaaaaaacaaaaaaaaaaagaacccagacacaaaaagcgacatcttttatgatttcatttatatgaaatgtccagaattggcaaatccgtggagacagaaggcagatcagcggtggcccaggactgggggaaggggcagtggctgcagcagcctcacagataagcagcagttgcccttgggagtgatggaaatgttttggaactggatggaaatggtggctgtacaagaatgtgaatgtaggaaatgctgctgaattgtttactttaaaatggttaatttttccctatgtgattttacctcattttagaaaaaaacgtgtctttgatcccgtcgcctcctgtttaccaccccattttcctgctccctgttacagcaaaacgatcccaaagagaactcacttccccagcttccattctcccctcagcaccgcaccattaaaattgatctgaatgagctcatcaacaagccacatcttgccagaaccaacagtcaatttcctacaacctcccggcatcttcagtgaggttgacctctcctcttggtggtgcggtggtgccatggagcttctgtcacagtggtggcagcttctgttgcagtggtggcagcctcctgagtctggagcattggggccgagtgtcctttggtaatgggggtagaactgcctacccaggcattttttttttattgatacatattagatgtacacatttgggaggtacatgtgacaagttgatacatttgtataatgaaaatcagggtaattaggacagccatcaccttacatctttatctttacactagaagcattcaaattctcctcttgtaggtattttgaaatgtgcggttgattaataactatagttaccctgctgatctacggaacaccaggctttatttcttccatctgttgtatccatgaatccacctctcttccaggctgttttctgcacacttccagagcctggatctgcagcctccccattgatttgctcacgagcctcccattaaattccctttctgcctgggcccctccaggagggtttctgctgctttgaccaggaacccagctgcccaagcagccccttcgagctgccacaccaggccactctgccctcagctccctcatctggttgatcgggggtcccacaggaccaagcaatttcatggtgggtcagtcctgatatggatttgacaacttgggtaaagaaatgactgggagtaatgtgactcccttttcatgagaaaagcccataaatgcgaatgcagcactcgaggtcccctcagaatttcagtggttgaaaagtggagctggatgttctaagactcagaccctcatcctggctcctcgtttgatttaagaaggaagacaaggccttgacatccacactggctgaggttccaaccctgggtctgcccccagccagctgtgtgagctcaggcgactgagttaacctctctgagctcagcttccctacctgcatcacaggaaggacaacattatccctgcatagagaccaataataatgcatggacatcatacacagcacctagcagagacttgtaaattgtagacttttaatatcctaagtcatggtgccttctaggaaggggggcggttacttaccattctgcaatctgtctaaactgaaccttcctgcaagatgctgcccagggaacattcctgccaaaggcaccctggcattaggtcagagtgctgcctctgcctccttcctgtcctagggaacctgctggatgggctcagagaagcggtgcctcccaagcactaatcacagaacttcccccacagcatatccagcactcccagcattgcagcctctgtgcccctcaccgccctggggtgaagcttcagcccaatcccttccagccttcaaagtctgaagcactaatcacagagcttcccccacagcacacccagtgctcccagcactgcagtctctgtgcttctcactgacctggggtgaagcttcagctcaatcccttccagtcatccaagtccaaatgcctgatgacatcctcagagggctgacatctgcccagtctcctctattggacagatccacagggtgtctctgtttttaactgggtgtggccttgacctttgtaagatgagcggctcctgaatgccttccagacgactaggacgaggttggctgacgaggacatagattttctaggctcaactcttggaattctcatttaatggatctgagatggggcagggcatctgaatttcaccaagcaccaatctgccctatccccgatgcacagtctccaaccaaaccattggcttctcagtgcctcccagactctagccttggcttgccaccttgatgatgggatgctttaggtagccttagctatcctttttacttggttgtgtcctaagccaggggttcttaccctggctgttcattaatgtataaatgtacaatgtataaaatcccaaagccaggctccttgttggacaagaggaattttttaaatattttattttattttatttattttatatttttattttattttatattattttattttattttattttaattattttattttatttgagatggagtttggtcttgttgcccaggctggagtgcaatggcacaatctcatctaactgcaacctctgcctcccgggttcaagcgattctgctgcctcagcttcccgagtagctgggtttataggcacccgccaccatgcctggctaatttttgtttttgtttttgtttttgttttttttagtagagatggggtttcgccatgttggccaggatggtctggaactcctgacctcaggtgatctacctgcctcagcctcccaaagtgctgggattacaggtgtgagccaccatggctggcagagataaattttttttttaaagctccttgggctgttgcaaggtgtggtgctgtttaaagtaatcactatcttaagtaatgatatgcatgaaatctaatggtaaaatatatacataaaaagacatgcatatatatgaatacccaaaacatgttcatgtctatcaaagggaacaaagtttccattagacaggaggataagttttcctaatctattgtacagtatgatgagcatagttaataataatgtatatttcaaaattgctgcaagactagattttaaatgttcttaccacagaaaactggtaagtaggtgaggggatgagttagcttgatggaatcattctatgttgcatctatataccaaaagatcacattgtaccacacacatatgtacaattatttgtcaatcaaaaataaataaataaataaaatactctgtatgatactataatggtaaatacaagtaattatgcctttgtccaaacccacagaatgtacaataccaagagtgaaccctaatgtacaaaatgacctttgggtaatttggatgtgtcaatataggtcccttttacattgtaataaatgcagcatcctaaggggatgttgctcagggtgggggtgataggccattcaagtgtgtgggtgtaggggggcaggtgggaaatctctgtaccttcctcataatttttctgtgaacctatcgtaaagctcctctaaatacaaaaacaaaaacgtgctcatccacaaccaaccaaaagtcatcctggctttcgtgttttgagaaactctaaactagatgctaaaaggcctttcccatctttctggtccaaatctaggaaatgacaggattcttcttatcgagcccctcttatgtagtagaccccaccaggccgctttgcatgtgtgatggcatggcgcatagcagcagccctcagcagaggtcatgatcagccccatttcatagacctggaaactggggcttaggggctcccaaagctgagtcttctaaaactaagaagttagctgcagagaactcaaccccagctgcacgcctctgctttctatcatgtcaggagcagaaaagtgagtggccctgcctttcagggggcttagattgaggagctgggattccatttgtgttactggtttgtaatatcagctaagcagagggccttccaaaggactggccccaggggaccaggaatgctcagatgagcacgtcactctgcagacagtccagatttagcactgtcacccatgccatttcctccctttgatttcttccaacatgagacacaaaaggatagagtttcactcatataagagaggtccagctttaataatcagcactgtaatgatcagagttttcattattcaattgtttgcatggccaacaggctggcccatgacctttcattcccagcaaagcctaattgcatgaaagtgccacacagtttgaaaacaggctgcattatttacggatccaatcgaattagcttgcaattcccagaccagctttagatcaatgagatgcattgtgtgttctcccacgtgggtaaggaggcctctctgctcctgggcagcccaagacagctctgtagtcagaagatgagtctttgacggcttccaaagcatcgtcttaatgggcacagtaggatgctagaggggatcccccaaatctatttcatttttaaacaaaaaagagtgaatgtttctgcttatgaaattctggaaagttagtcctagccaggaaggggccggaggactccgttgcagaactcctgccttgtggaaatcaggaaaccgagactgagtgaagcagccagttagcggagctggagaaggatgtcccatgtcctgagactgaccccattcttgatcccaagcactgtaaatactgtgctgattaagatttagccactgtcccctgggaatgcactgggaatgagggtcaccaagaggtcacaggcataaaaagaaccttcctgcatattgttatctgtgctctgacagaggcaaaacagggcgctggaaaggaggcagcgtgtttgttttagcttcactcattcatgcgttcacttattcatccgatggtgtatattgagcacctaccttgtgtcaggcccaccctattctaggcattatggacccagagccaacaaggtgggaaaagtcccatctccagctcctcacaccaagtggggcatcagactaattaaccaacacacttaaattgacgttcaggtaccattatagcaaactctagaaagcagtgtaaggtgatgagagaggcaatatcaggaaattctgatgtgatgggaggagtgggaattaactgaacatctgtagatgtggggttgtgggttgggtgggggtccaggcagaaggagcagcaagggccagggctggaaagagcttgtgtgtgagggtttcagggactggtgtggtggggttgtcaaggcctgtcttgtgacgtggttagggatgtgggactgcagcctaagagccatgggaaatctagatggtttctatatttgggcaagggggttggaggatgatcaggggagctctttacaaagagctgctggctgctgggctgtcagggttggggagaatggggggatggtgacaaggtggaagcagagaccaaatttggcccacataaaagatgatgctcataccaagtcaagtctactaatagtaaactaatccaaggatcacaggagacaagccctgccaagtcctccatgcacacagtccctggccatggtcaacaggagacctgtgtagctactgtcattacccagcccgtgcagctctcacaccctgctggacaggtgacgtttatcctctttcaaaactctccaggaagtatcttgtgggaaggtagtgaaatttggcttcaatggcatagtgaggttgcagttctgatgacctaaccgtgaccatgggcaagttatgtaaccaagctgagtcaccaattctttgttcataaagaaaaatttgagtctctctttgcaggtcgagtgctgcaattaaaaagatgcatgtaaagccgggcactgccgagctgttcactaaaccttagtcctccccaaaaccccacctatgtgcagactcctccctcatccctttcacgtgctgaggagtctctgagggtctaactcagtttcctccttttgtccagggctccatgaaaatcaaatttctgctcttaatggcttattatcacttgctcgagtgtgttatgtgggattgtgttacaggaaagagctaaggttgtttgtcttgcaacagatgggataagtaagttagagcttcggtatgtcacccccactgtctatcagcccggctgcttcccaccttcctgtctccattggaggctcatctatctactcccaggcggcttccttctgactcagatggcttcccggcagccgaagcatgattctagaacaccctcttccccccggctctgcttctgtgaacacactcaaccctcaaaacttagcctcagtcttgccttttccaagaaatcttcagtatctacccagaaatcatctggatgaggaacagtgttttataaacactggactaagatatcccagcctggcttcctctgagcatctggcccgcttaaaatatgtatgtgggacaagcagctgtgtggctgaagccttggtccatgtctaaggggcagacttccgtgttagttaccccaatacgcccactctctgcttcagtgagcaagctctctgcactcgcctgcttacccactcactcagcaacacctgcagctgcctggccgacctgggtggggctggggacgctgaggtgggaaacgggtgtcgctgtgctcgtgggttgtcatcccggtggtggtgtccgaaatccagggcgagggccacccaaactgttcccttaaagaaccacatgggccctgtgtccttaagccccagggctaatgtcatcccaagcccttctgccctgcagagctttccgcccttttcaagggcttcccccgccagccccttttctcctactctgtccccggggatgtttttctcttactgactctctcccctcagcagcacccccagcacccaccaatcttccctgatctgagccagtcctgacatatacaccacagaacgtcccgtgctggatcggcttcctaaatccccttgggggaatcaaaagaagaaaagtaacaaatctggagaactattactatttcatgactcaaaagaaacaagaaaagtatggagtcaaactgaagcatacattcaatacacatttttccaggttttaatcatttcattcattaaaccccgtacatgagcgcacccacgcaaggagctgatggacacagaggcacgccgtccagccctcctgcgaccccgcacttgtcagccaggaatgtcctggcacacctgcagtttcgaggtcccctgggggagcagcatggaatcagtttctggcaaagccaaggccacagccgcagggtttgccttgggagatggtgagagggactgtagccagagctctcacttggcattttgtgtgccttcatccttacagctcttgtcttcatacgagggcagctggagcctgttgtgagcagtgcaggactcgcggccaggctccctgagttctgatcctgcctcttccccttgttcactgtggcgtgaggcaaatcccttccactcatggggcttctgtgtcctcatctgtaaacaggtgtgcagacaatgatgccagcctcacaggagtgttatgaggattgaaacagtaggtacacagctcctagaacagcacctggcactagaaatgtttgatcatcagtgggggaatcaaagctcagagaggtgaagctactagcccaaagtcacacagcaagaaagaagcaggatgacacgtgagccaagccccctctgccacactagctctggaggccattggctctcaggtgatgggttttctttgtacctggacatgggggtcaggaaagctccagtgtagctgctgacctttgacctgaaggaatctgggatctctcagatggggagtccaccatcagtctcagcaaaaacactaccaatcaaccagtccatcgctgatgtctgaaactctctggtgcaggacgtttcaccctttctggttttgtcgagttggccccctcctggtagagcactgccaccccgcaggtttccaagggccaagtcctggtagtactgacagttgaccagctaagctgcatcctaggcacccaggctgggctcgggctgctgtgtcaccaaaatccctggtctttgtaccattgggtacaaagaacacttctcaacagaagtggagcgaagtcctctttgcctcgacccttggcctggtgccaggccttctgttcactctcagatcagggatgctctggcctcctgggggactaagatgttcaggagctcatcctgggccacccacaggcatcccagctcctctcaatgctggttgcttggcactgagccataattgaacgattccagacttcaccttctgcatctcgaaggtggaataagggcaatgaaccccacctcatgggctggctgaagggatacctgcatggatcctgggtgtgatgcttaatttcaggtgcctgaattaaagaatccctagaaagctggtcaagcctcactttggggtgtgtctgtgacggcgtttctggaggagactggtgtgggagtctgtggactgaagggagcagatctgccctccagtggggggcaggcaccatccattgactggtggtctagatcaaacaaaatgggcagaaaaaaaggcatttcttttgtttgtttgttttgttttgttttgtttctctgtctgtctctctcctggagctgggatactcttcttctcctgctcttgaaggtcagaactccgagctccctgacctttggactttaggacttgcaccagcgtcccatccactgctctggttctcaggcctttggcgtcagactgagaattaccattggctttcctggtgctgaagcttctggatttggactgagccgtgctgccagaatcccagggtctccagcttgcagatggcctgtcaagggacttctcagcctccataatcatgtgagccaattccataataaatcccatccatccatccatccatccatctagctagttagctgtccacgtcctgtgtatataaacagattataacacgttttctgtctccctggagaaccctgagtaaactacacttgagaaggcccagttccacccctttgggcttcggttccatcacttgcaaattgtgtgaccccatacacatttccgtaaacctgagcctcagtttcctcatttgtgaaattgaccaaaaaaaaagaataactaagtcccagactttgggtcaagatgaaaagagatagtgtacgaaatgtctgatcacagtgctgaaagcgcatatcacagagtaaaattcaaccaatccataaggccatcgctcttccataacattgtggctgtgctgctattgggtgtttacgctacacacacaattccatgtggtggtttcaatattctctttaccctttgttgtcctgctttttccagtttccattccagtgtatttttcctcaacattagcatcattttacatggctgtttaacattctatcttttactcggccatatttcatttaaccagtcggtcatttgggttttctccctttttccaatactacacacagctctgtagtgagcacgtatgggtaaatcattcctccatcatccagattctatccttagcacagatttcaagaaatggaattattgtatcaaaaggcaatgcacagaaacaacaggcggtgcatgcttttaaatctcttgatgcgtattgatctttcatgttccaaaaaggattctagtccgggatttccaccctggtaagtatcaggaggctgtgtggcccaccgctcctccttgggcttgctaaggagcaagcggggcctctagacttaattgttaagcattctcaaatcctgctgcacaaccttgttcagaaatactgcctttgagtcattcactcatttatttagtcattcaatgcttaattcccaatcctcagcctactcagccatctttctttttaatagccttgttgaagtgtgatttatgtaccataaaatgcactcattttaagagtacaatttaacggtttttagtaccctcacagcagtatgcaaccatgatgacaatctaattttggagcattgtcatcatctcaaaatgagacctcagcccctggccaccactgaactgtgttctgcctctctagattacggacttgccttttcggaacatttcataaaaatgggatcatacggtacggtatatgaccttttgtatctggcttctctcacttagtgtcatgtttttgatgttcatcctgtcgcattagccttcttctgggcaaacctttttctcctggcctcctcgacacagtgctctttacattttctctacttcctcagttgctcctcccagagctgagactggggtgaagtgactgaggcagttgtctgggaatcaaaattaaagagaatactgaaaactcagtcatcaaggtaaataataattaatccaacagtttaaaaaataaaatgaatgaaaaaaacctaactttatcacaaacaaaatgtcaacattttaaataaaggcaggggctgggcacagtggctcacacctgtaatcccagcactatggaaggccaaggtgggcagatcacttgaggtcaggagttcaagaccagcctgagcgacatggtgaaaccctgtctccactaaaaacacacaaaaaattagccaggcgggtagcgcatgcctgtaatctcagctactcgggaggctgaggcacgagaatcgctagaacctgggaggtgaaggttgcagtgagctgagacggcaccactgcactccagcctgggtgacagaatgagactctgtctcaaaaataaataaataataaataaataaataaaggcaggacccacggtagctgtgataaggaggaggtgagtgaggtgagtctggcaggaagagagttggccttgagacaaggtgtccccatcacactgtctggaaaatggtcctgagcactctgggcctctttcttgctttgatttttctccctaagactttctgcatttgtgagtcccttacatagtatgtgtatatttgtgaagtgtgtgtgaggggtgatgcctttaaaaaaattagtccaggccaggtgcagtggctcacgcctgtaatcccagtgctttgagaggccgaggcgggcggatcacttgaggtcaaggagttcaagaccagcctggccaacatggtgaaacccagtctctactaaaaatgcaaaaattagtggatatggtggcaggcacctgtaatccaagctactagcgaggctgaggcaggagaatcacttaaacccaggagatggaagttgcagtgagccgagatagcaccactgcactccagcctgggtgacagagtaagactctgtctcaaaaaaaaaaaaaaaaaaaaaaaaaaattagttcagacaagtgggtacagccaggccacggaacaaagtgttcctctatcacttggattcttccattaaaatagatttcaatcaatggaactactgtgtcaaattcaaggcaaaagaactaaatgcaatggacattttaaagtcgcttgatggatcttgatgttttacaccaaggttttacgcaatgacatggagcatgtctgcttcacatcccgggagagcctcggacggcaagctaaggatcccgaacttgattcttaggcatggagggcttttaggcaaagagcaccaaggtccctcagtcactgtcaaacactcattcacacaaaacagagatggcagcacactagagcaggatcaacatttttcttaaagggctaggtggctaaatagtctcatctaagctagccatggaatttctgttgctctcacaactctgccgttctagtgtagaagcagccgtagacaatggttaaacagatgtgcatgattgtgttccagtaaagctttattttaaaaagcaaggagctggcccagttggcatgtgagtcaaagtttgctaccctgctctagagtgttcatgtgagctcaatgaatctccgacttcatgcttgttgcagaaatggacctggaatgtcccttaacagttttcagtagaactgccttactcagaacttttctctgacagtgtaagtgccgcacacacttaacagtgcccagtggagcaccctcatgcacatgcagtgtgagccttttggaagctggtggagggccagtgcatggaggagggaatgaatgaatgtccatctgtgctcaacagcagatagtgcaagatgggacgtgaagggccagaggaaactggaaggtatgcaaaagccatttccaacaaaacctgtagtttcccatgaagtgaacacttcttttcccccacctcctcgtcctccgctattctctatcttcatgaacaataacatcaaacacctccctcctgcttatgctaggtgacgcctaaataacttgcctcatcctcctcgctgccttccttctcctggatccccacattcagggggttctatctctgaagatggttctaacttggtcccctccatccccactgtcatcctcctggtccaagcccttgtcttctccagcaggctggacatcagcctgctgactggtctcaccatggcccatctccactctccagtccaattctctacagcatccctggagtcatctttctcaaaagcaggcagtgtcattgcttctctgctccaaacccttagatggcttttagttgctcagttctagattaagccttcacttaaagaaagaaagaagaaaggaagggaggagggaattgcaagcatctgcaatgagcgccagttccagggcagcactgtgccagtgacatctcctctgcacccacctgcccctggcacatgacctgcagagacaccaccggctcccagcatagagagctccactttgcccacacaccttgccctgctcccgtcgttgccttggcattcaacattcccccaaccaggagcacccttgcctgttttcttggcctgaccaattcctactcacattttagggttttcctccagttcgaatcttcctctgcatctccttcaggaagagttttcatgcccctctggagtccagaatgtttaattccagtgcctggtgccagccctagagccaacactcagccaacaggaactgagtgaataaatgacagtcagcttctatttgtgagaactgatgttgaccaagttgaattgtaattgtttgagtaacttttcaaaattaatcatcgggtaatgccaagcaaagaaacagaaagggagattcacactgcgctatgccattaagtaaccctctttccaggtggctgctcacatccccagggagaaaactgacttttgattacctgttagtgtaagtgctttctacgtgttgtcttgtgtactcctgtgatacagaagctctaccattcccattttatacattcagagaggtcaaataactcgcctgaggtcacacagccaggacctggaactgaagttcggcagcccccatacccttgatctttccccatgcttagctatccaccagacacaagagaaactgctgtgcagttgctctgtgctctctgcatcaacccagtagcaaccgcagagccacactccttttctgaagcttaggggattttatctgtgagagctgggaagtagctctggggaacattggagggtcagcttcctgatcatttaaagattcgaatgtccaaagaatccagagaaaaagaacataatctctagtatcagaagcctggagattagttccactgtgttggtgagcagccttctagagtcttttttaagctataggcatcttgcctgacatacagtatctgatgactgctggcctagccacagacaaatctcagctcaaaaatcttccatcccacagtgaagtagatttcagtcattacccctttgtgccttgagtgggaggtggcggaagttcctactgcaaacaacactcagggagtgtcaccttaacttcatggcatctgggacccaggtttcaagccaggctcttttctctgtgtgctgaagaatgaagtactgccaatcacttctccctttgggggtgtcagcccctggagccgctgctccttaccatagctattggtggttggctttcctatgccaaggcaaaaatcaacaaaccccacgtttctgaccccggtttttggtgaaacacctgctgggtcttctcattacaaccaaataccagaccgatcgttccaaacacaggaattgacctttccttcacttggttcccaagaaggccaaaattgaaaaaggaaaatgcaatgagacctggtttttcaggcagaagggggaatggggcaaggcaggccagaaggccatagaatttgcagacaactgaacaatttgagtaaaagctattagtgacatgccattttcttcttgccaagaacagtcttcccttcataaatatctgcagggtcatgactgaagtaaacaggtggtttgtaataattgtatcccttttactctctggtgcagccaaagtgcttgataaataaatgagtgattataagccacacacttaagaagttagaaagaaaataagaaaaatgttcacagtattttctaggaatgtgtttggttttgattccatataaattttcatggtttttttctaattgtttttctaatcatggaaacattattttgaagtgaaaattaaactattttaaaataaggtgcttacaatgatttgcagcattcaaattgcctttaattctattcaaagcaggttacactctatttccttcaacaatccttttgaaaccattatgataattatatttggcataaaatgttcatatatgccttgataatacatgactttaaagacttaaaaataccaaaaaatggccgggcgtggtgcctcacacctgtaatcccagcactttgggaggccgaggtgggtgggtcacaaggtcaggagatcgagaccatcctggctaatatggtgaaaccccgtctctactaaaaaatacaaaaaaattagctgggtggtggtgggtgcctgtagtcccagctactcaggaggctgaggcaggagaatggcgtgaacctgggaggcagagcttgcagtgagctgagatcgtgccactgaactccagcctgggtgacagagcgagactccatcaaaaaaaaaaaaaaaaaaaagcaaaaaaccaaaaaattggataacctagaagaaattaataaattcatagaaacatatagccaactaagattaagtcataatcaaacaggaaatctgagcagatctataactagtgaggagattgaagctgtaatcaaacagctctcaacaaagaaaagcccaggactagaaggattcactacagaattctaccaaacatttaaagaactaacatcagttcttctgaaactcttccaaagaactgaagaggagagaacactctcaaacttattctatgaggacagaattaccttgataccaaaaccagacaaagacacagcaagaaaaaaacactatagataaacccctgattaatattgatgcaaaaatcctaaacaaaatactaccaaaccaaattcaacagcatgttaaagggatcatatatcatgaccaggtgggatttatgcctagaatgcaaggatggttcaacatatgaaaatcaatcaatgtaacaaaatggaggactaaaactgcctgatcatctcaatggatgcagaaaaaaatatttgacaacattcagccccctttcatgataaaaaaaacactgaacaaactaagaatagaaagaaactaccacaacatagtaaaagtcatacatggaaaacccacaacagacatcatacccaatggagaaacactgaaagcttttcctctaagatcaggaaccaagcaaggatgcccactctcaccattattatttgacataatactggaagttctagccagaacaatcagaaaagaaaaagaaattattaaagacatacaaaccagaaaagaagacttaaaattatttctatttggaaatgacacagtcttatatgtggaaaaccctaaagatcctaccaaaaaactgctagaatgaataaacaaatttagcaaaatttcaggatacaaaatcaacactcaaaaatcaattgtgttcctatacactatccatgatcaattgaaaaaggaaatttttaagaaaacaagttcatttactatagtatcaaaaagtataaaatacttgggaataaacttaaccaccaaggtaaaagacttgtacatggaaaactaccaaacattggtgaaagaaatcaaagaggatacaaataaatggaaaaacatccaatgtgctttaattggaaggattaatattgttaaaacgtccatattacccaaagcagtctacacattcaatgcaatccctgtcaaaatcccaactgcatttgttgcagaaattggaaaaaaatactaaaatacatatggaattacaaggaccccaaatagccaaaatgatctttaaaaagaacaaagctggaggactcacactccctgatttcaagacataatacaaagcaacagtagtggtactggcataaagatgaatatatagatcaatggcaggagcagacagccaagagacgaacccctgcatttatggccaaataatctacaagagttccaagaccacagagtgaaaaaaggatagtctgtttaaaaaatggtgtcagaaaacctggatatccacctgcaaaagaatgaagttggacttttcccttgcagcagatatgaaaatcaactgaaaatgaatcaaagacccaaatgtaaggcctaaaactattacacccctagaagaaaacataggagaaaagcttcaggacattggatttggcaatgatttatatatgacacccaaagcacaggaaacagaaacaaaaattggcaaataagactacaccaaactcaaaaacgtttgtgcatcaaaagaaacaatcaacatagtggaaaggcaacctatgggaggaaataattgcaaattatgtatctgataagggattgctatgcagaatatataagaaatttctactactcaacaacaacaacaacaaacaaataagacaatttttaaatggggaaaggacttaaatagacatttctccaaagaagatatgagtggccaataagcacataaaaagatgctcaatatcactaatcattagggaaatgcaaatcaagaccataatgtattgtcacctcatccatcaggatggccactatcaaaagaatggaaaataataagtgtcagcaaggatgtgaagaagttggagcccttgtgcactgttagtggaaatacaagacagaaaacaaaatacagaagttcctcataaaattgaaaattgagttaccatatgatccagcaatcccacttctgggtttatatctagatgaattcaaagcagagtatcagaaagatatttgtacatacatgttttcagtacagcattattcacaatagccaacaggtggaagcaacctagattcccatcaacagatgaatggataaagaaaatatagtatatacataacatagactactatgcagccttaaaaagaagaaaatcctgtcacatgctacaacatgcaacaatttcaaagacattatgctaaacacaaaaagccatctgcagaagaacagatactgtagggatctattttaactctatagtatctaacatagtcaaaattatggaaacagaaagcagaagggtggttaacaacagccagagggaagagagaaggggaagtagcgtctagtggatatagtttcatggttgcaagatgaaaacattataaagatctgttgcacaataatgtgaatatactcaacactactgaactgtacacataaaagtggttaagaaagtttattttattttttattttatttattttgtatttatttatttatttatttattttatttatttatttttttttgagacggagtctcgctctgttgcccaggctggagttcagtggcgtgatcacggctcactgcaggctccgcctcctgggttctagcgattctctcccctccagcctcccgagtagctgggactacaggtatgcgctgccatgcctgtctaattttttgtgtttttagtagagatggggtttcaccatgttgaccaggcttgtcttgaactcctgacctcaggtgatctgcccgccttggcctcccaaagtgctgggattacaggcgtgagccacggcacccggccagaaggttaattttaattttctgtatttttaccataaaaaagagcaaaaaaagtaaacacacctttttatgagatagtcatataaaaagactaaatctctgggttggaatatcacaaagtccaagtgaggaggtttgaatgaataaagctcactgtcaatgctgtgacatatttccacatctcagtaataattaacacattccatgttgctgactccaagaatggtatttcatttatggctcaaaagacccttgagtttgtggtttctgtaatcatttgtctttggaactatttcaaatggagaaatgccgataggtcagaatcttccagttcaaagtgtctctaccttgagcctgactaatcatctccatctgaatgactatccattccaagacaagcaagagactgttactagtgacctaactagtacaggaaacaataatttgctgtgcttttttcctttcaaaaatatcttatcattcatcacctcatttaattttcacagcaatatggtatattactctgttttcacactactgtaaagaactgcctgagattgggtaatttataaagaaaagaagtttaactgattcacagttcagcatggctgaggaggcctcaggaaatttactttttttttttctttctttcttttttttttttgaggctgagtctcgctctgtcacccaggctggggtgcagtggtgcaatctcagctcactgcaacctgcgcctcctgggttcaagtgattctcctccctcagcctcctgagtagataggactacaggtgagcaccaccacgaccagctaatttttgtatttttagtagagacggggtttcaccatgttagccaggctggtttcaaactcttgacctcaggtgatccaaccgcctcagccgcccaaagtgctgggattacaggtgtgagccaccgcacctggccgaaatttactttcatagaggaaggcaaaggggaagcaaggcacatcttacgtggtggcaggagagagggcagaagtgccacacactttcgaaccatcagatctcatgagaactcactcaccatcacaagaacagcataggagaactgcccccatgatccaatcacctctcaccaggcccctcccactatgtgtggggattacaattcaagatgagatgtaggtggggacacagagccaaatcatatcacatggtaagccatgacgtttagagtttatgcctgttatgggttgaactgtgtctccttgaaaagatatgttaaagtcctaacctccgggacctatgtatgtgcccttatttggaaatagactatttacagaggtaatcaagttaagatgaagtcacttggggtgggccctaatccagtatgactggtatccttataaaaaggagactgtgacacacagggagctctccttgtgtcgtccatatgatgacagaggaagagcttggagtgatgcagctgccagccacaggatgccaagggcccatgggcaccaccagaagctgctagagggaaggaaggattccacccagaggctgcatgaccctgctaacaccttgattttggacttctggcctccagcactgtgggagaatacatttccgctatttgaagccacctggtttgtgagactttattacagcaaccctagtgacctcatccaatactgcttctgtttgctccatctgtgactgtgatgagccactgacactttagcttctcccaagttcaccagccctctctgttctcctcttttaagccagatcccagattttaccttaatatccacccttactctaaagtcttctgcctcccttccttcttcacagttttacgtcagcattccaagccgagatggctccaactctccactttctcttctgccttgtggacaggccagccaggaagatggattctgtgatggtttaatgtgatggttctgtatgcatcaatatgcttggactacaaggtgcccagacatttggtcaaacactactctcagcatttctgtgaaggtctttttggatgaaattagcatttgaagtagccgactgagttaaagcaggctgcccttcccctgtgagtgggccttgtccaatcagctgaaggtctgactggaagaaaagggctgaccctctcccagataagaggggatgcctcctgcctgactgcttttgagctggatcattggtctttttcttacctttggatttgaacaaaaatgttagcccttcctgggtcttgcacctactggtcttccgaagagaactacaccattggctctcttaggtctcaggccttcagatgtagactagaactacactgtcagcaatcttgggtcttcagcttgccaactgcagaccttgggacttatcagcccaccatcatttcatgagccaattctttatagtaaatttatgtacctctctctatctttttattggttctgtttctctagagaacactggctaatgcagattccatcacaacacatgttgccatgctcagatgggtggcatgctatccaaaatctcattctctaaaaagtgtttcttgagcctcctttgttttctgtaattctctaacctccccatctatctcttgccctcagcagatgactggcgaatgctactgatattccaactgcagcccctctgttagtccatatcctagtcccttcctgctagaaatggtgctgatagaatctcacagctgctcccttttccgcagaacagcccccagccaacaggaagccttactgggcaggccaccaacctcaggcttggccaatgacttcctgatacaagggcgtaaatggcaggttcccttgcctcaaggtagaacttgaagtagagacagtagcgactccctcatttaatacccctaaagaccctgtggccacttactcaagtaaccatgcactaggggaaagtaagagatgtttctggtgctgttcgatacagggtctgggttgatgctggtatccaggaatccaaaacatcacccaggctcccctgttatcattggccatatgggagtcaggtagcaaatagagctctggcccaggtgtgtctcatggtagtgcactgagtccccacacccaccccacgctcatttccctgggccctaaatgtttgtaggaaggacactcttagccatcgggaggaccctcactctgcccctgacctgcagtgtaaaagttattacagtagaaaagaccaactggagccctggaatttcaacttcctgccaagatagggaatgattttctcttctcttctcttacgtggctaagagaaggaggaacgatattgcatcccaggaaaatggcaagggctagggccatcctcagagtcttgaagcatccaggagcagtggtgcctctcacatgctatttgattcactagcccgatcctataaaaattatatggatcatagcagaagaccctggaactttagaaacatagccaagtggtagccccacctgcagttgctgcctgatgtggtgtctgttctagtgcagattaacaaagcctgaggcatattgagtgcagccactgattggcaagtggaattttaaattccatgcctctcagaaaaggagatcagaagtagtttacattacaggggacaaaaactggaccagaatgtctagtccagacagctcaactaaggtccagacctgcatattcagctgtgtacctgacataaccatgtggtgactcacagactcttgagtttctcccccaaagtcttctcttatcactggccctgtgattgcctcaatatctcagtagataaccccaccagcttccttgtttagctcagcatcacctttgattccttttgcttcctttttaacctcatccatccatcaatctggtattgaatctgatccaagctgtatctcagctctatctctcttcctgcttggctgccactcccagcccagccttcatcactctcctgccagatcgtccctcagtgcttctcattgaacttggaggacaatctgcatttccaccatgtcctcccttcatgctccagccagcgcatggtgtatttgtcactcttgacaatcattttgtctgttgacaaaagctcagcatgaggcagaactgtgtctgtcctattcactgttgtatccccagtggtgtccagctcttagaaagtactcaataaaacctcaatgccttaggacttaacatataacgaaaggatggctgaattactaccaaagtacgttcttgtgcaacactcagatctggacagtaccagccactgtcatgtgattgaagcccttttattccatgtttccaaaatagtgggttgtgaagtttaatgcaaccagaagtgcagtgcaagaggccagagggaggagaggcaaacagcctagtgaggtgccccccttgagaacaccttttttccagggtccaccacggtgccaacctggactttctgcagaggagccgcggcccttggtcagccgcagcccccaaggatcatcaccattggggaaaaacattccagctgtggtctgagggctatagagtgagtttgtgtgattgaatctagaatctaaaggaagaactgtcttgccttttatccactttatatgccaacgtgttcgcttccagccacaattccagactttgagagcatgctgaattttgatcctgaaactaaatagcattgtgtcatcacaaaacagttaataatggcacatgccgtgttttgactgatgtgtttgataggtggaggtgaaggacaggcagtctgtatcttgtagagatgattgtatgatgtatgatgacggtgccctatactcgctgtgtgaccttaagcaaataactcaacttccttgtgccttctttctaaaatggcaatgataggagcacctgtgtcctcaggctgctgtgaggaatgagtttccacacacacagctgttagaactgtgtttcacatgttaaaagcgctattgtgagagacaggaagaaccagtctctcctagtttcccacacacaccactcacctctggtcaccaaaaatgcatgaggatttatcctcactagcaactaattctccagcagacaccagctgggcatcctctaattcaattcaattctgacattgtctgcctagagagcgtcagatcccacaagttaagggctcagtcccacaagaccgcccccctttcagatgcaagtcacaagccctaggttgtgacctgtacttttaaccaactggctataaattggggtttcctgtgacccattcctcaggtttgattaatttgcttgagcggctcacagaactcagggagatacttgtcttacgatgacccatttattataaaggatgttacaaaggatagagatgagcagccagatgggagagatgcgtgggaaaaggtgtggggaggcgacagggagcttccatgcccttactgatggcacctccccacctccaggcatccccacatgttcagctgcctgcaagctcgccaaaccctgtccctttgggtttttatggagacttcattacataggcatggttgatgacatcactggccattggtaatcaactcaacctccagcccatctcctctcctcaaagggtggggatcaaagttccagccctttactcacatgcttggttaccctggcaaccagccccccaccctggggctatcgaggagcccaccaagagtcacatcattagaagaggaaatgcccctatcaccctggaaatgccaagggattcaggagctgtgtgtcaggaaccaagaggaaaagactaaatcgattagaacaaaagattctcctagcacccctatctaccagggttttaggattcttatctcaggaactgagagcagagatcaaaatatacttcttgtcacatcacaaatcacagatatgtaagcatgtgctgttgtttttagtattatagtaacattacctctatcacgttagagattgtgaaatgtcatgtcagagacttcagataacctgtcccaatcccagcactggaacagcagagtcagggttgcatgctgtttcctctggccccgcagctcatgccacttccaatatgagatgtctaggttagctgatatctccctctctttatctgtccttcatttgggctttgttttcacatctaagggcggagagaatcaagagaatctgttcccccatgacaggcattcaggcatttcaagggagtgttcatgaatccctgatccagatggtctctgctccaggctaaccagcccctccctttaaggagactttgttggctcaggcagagtctaatcctccctgatccctccatatttctctcacctgacatgtactctgtctgcagcgctatgggttccaccacaaaacagatcccgcggctgcctgttttcattactctactctcagccagccaagatgccttcccaccagctctcacagcctccacccttgtcccccgcaaaccgatcgcactcagcaacaaaggtgatcattttcagtgtcaatcagagcatgctgccacccttcctaaagccctccagtggcttcccattttcctcagaattaaaacccagggaccgggagtggtggctcaagtctgtaatcccagcactttggaaaggtgaggcgggtggatcacctgaggtcaggagctcgagaccagtttggccaacatggcaaaaccccgtctctactaaaaatacaaaacttagccaggcgtggtggtgcgtgcctgtaaccccagctactcgggaggctgagacaggcgaattgcttgagcccaggaggtggaggctgcagtgagccgagatcgcaccactgcactccagcctggatgacacagtgagactctgtctccaaaaataaaaacaaaacaaaaaacaaaataaaacaaaaaaacaaaacaaaacaacaacaacaacaaatcccaaaccacttggcccataacatcccagtaatctgatccctgctttgatcaccatcatctcccttctctgacccccttttcaccttgccccggcaacacggctggctttctgacaattccttgtgcatgcctcagggcctttgctcttgctttcccctatgcctggattattctgccccagatcagaggctccttctcaacatccaggtctctgctctgttatcacctttacagaaaggctttccatgaccatgctctcaaaaacaatcacactacaccccttaactctctatccctggaccataagatgtcttcttgtatcacttagtactacttgatatatataactactcttggagagctgtcctcctctctagaatgcatactccctgtgggaggagagatcacctctgatctgccccatgtataatcagcacaatattggcacagcctaggaactggtggggcaggcatattagtgcttcccacctgctcccaaaaatatccacatctgaatcctaggaggctgtgaatatgtcaccatacctggcaaagggaaattaaggtggcagagagaatgagtgttgtaaattggctaaccttaaaacagggaaatcatcatcactttgggaggctgaggcgggtggatcaagaggtcaggagatcgagaccatcctggctaacatggtgaaaccctgtctctactaaaaaatacaaaaaaaattagccaggcatggtggcaggcacctatagtcccagctattcgggaggctgaggcaggagaatggcgtgaacccgggaggtggagcttgcagcgagcctagatcgcacaactgcactccagcctgggcgacagagcaagactccgtctcaaaaaaccaaccaaccaaccaacaaacaacaaacagggagatcatcctggtttatttgggtggatccactgtcatcacaagggcccttaaaagcaagagaggagctcagcctggtggtcatgcctgtaactccagcatttaggaggtggagtattgcttgaggccaggagttcgagaccagcctgggtaacatacagagatcccgcccctaaaaaattttaaaaattatctcggcatggtggtgcatgcctgtagtcctagatactctagaggctgaggtgagaggatcacttgagcctgggagatcaaggcagcagtgagccgtgatggctgagcactccagcctgggtgacagagtgagaccgtgtctcaaaaaaaaaaaaaaaaaaaaaaggtgggagaggagacaaaagagagtcagagagatgtgtcagaaagatgtgacatggaaaggacccagctcacccttgctggttttgaagatagaagaagccataggccaagaaacccagacagcccctagaagctctaaaaaaatcaaacaaacagaccccacccagagcctccagaaaggaacagccctgctgacatcctgtttagtccagtgagacacagttctaatttctccagggctgtaggataatgaacctgtgctgtctaagccaccaagtttgtcggaatctgttacagcagccacaggaaactacttcagcactaacaatgatttgctgaaggaatgaataagtgaatgaatggagacaatagcgagggaccctgccacatcagccagggcccctgtaacctctgtgtctgtcctagtgtgcggtgtccaaggggcccaagcccatccatgccgttgattggagccacatctgccctctcctttctagtgcccctactaggatagccagaggactcactagtttgattcaaggtagccacattgcacttgcctcgtatggaatcggtcatacattaagatgctcaactggaaattcatgtgcccctggagccacgtgttgcccaacccgcttctgtgcctctggttgtgtgtgtgtttgctttcctgaggttaaggtacattcatctcaatgcagctctacttttcaatttttctttgttttttaacatcatccaaagacaagagagaagaaaagcaagagagaggaacatcaaaggaaacttaacctttttcaatcacttgaatatgtcattcccatggattcgtacaactttgttgtaatctctccacttacaaatgaagaaaccaaaatattatttatttgtttagtacctaattcatttttcccacttactcatgaactcttttagtaaacctttactgaggaaacgaggcattgtgttctgaacatcacacatgactgctactgcctggatgtgtcccaattttcaaaaggttaaaatgtgaagtcatgcacatcttatagtcagaacaataggataattcttagcagagagacagccagtctggcatcctagttctctgtactgggctcctctagaaagtttatcagattgctcctgatatttaaaacaacaacaacaacagctgcagcaagaaaacacagatggccactcaccacctcgggtcttgcactgacttggtgctagaactcttcatgggcagagcgtctgattcatgcccacacagcaatgtaatttaagccacacattcatgtccatgaagctcccattggctagactcctggtcctacctccaaggtaaagctggtttctaaagaatttctccaacgtgttctggccttgccagtaatattttcccccaagctctttttccagttcatcaaaaaggttcctgttggccaggcacggtgtttcatacctgtaaccccagcactttgggaggctgaggtgggaggatcgcttgagcccaggaatttgagatcagcctcggcaacataatggggccccatctctacaaaaaacacaaaaaggttcctgttgcctctttagggctccctccaaatcaccttttgtgagatcccaatcaccttttgtgagatgagaagttagtttccacaatgatgaagtgtttcctcctcctaacacaagagtttctcagccttggcaccatgacatttttgactggatacttctgttgcagggcctgtcctatgcactctaggatgctgagcagtgtccctcacctgtgcccaccagatgccagcagcacccccattcagttgtgacaaccaaaaatgtctccagacattgccaaatgtcccctggggggcataatagccccagggttatttctaactctagtgttctattttagttagaccaggtgctctgtattgcccctggcaaggttgaatatcctgtgcttctgtgacactcattgtctgctcagggttttcaaaacaagccagagtggtgatatggtttgttcgtgtccccacccaaatctcaacttgcactgtctctctcagaattcccacatgttgtgggagggacccagggggaggtaatttaattatgggggccagtctttcctgtgctactctagtgatagtaagtctcatgaaatctgatgtgtttatcacgggtttctgcttttgctccttcttcattctctcttgcagctgccatgtaagaagtccttttcacctcccgccatgattctgagacctccccagccatgtggaactgtaagtccagttaaacctatttttcttcccagtctcaggtatgtctttatgagcagcgtgaaaacagactaatacaagtgggatgctttgtttatgactgtgctgagtaagaggccagtttttatcatggtagtgtttcatcagggttctccagagaattggagcagggtgtgtgtgtgtgtgtgtgtgtgtatgtacacagagagagattttttaagaaattgacacacacgaccaggtgcagcagcgcatacctgtaatcccagcattttgggaggccaagcagggagtatcagttgagcacaggagttctagaccagcctgggcaacatagtgagatctcatctctacaaaaaatacaaaaaattagccaggtgtgattgagtgtacctatagtcccaactgctggggaggtggaggtgggagactcatctgagcccaggaagtggaggctgcagtgagccatgattgtgccactgcactccagcctgggcaacaggagtaagacgctgtctcaaaaaagaaaaatttgtgcacatgattgtggaagcatggtaaatccaaaacctgtaagacaggctggagttccagggaagagccatagcccaagttcaaaggttatttgctggcagaattccttcttgcttaggatagggtcagtctttgttctagtaaggccttcaaatgattggatgacgccagctcatgttatagagggcaatccgctgtattcaaaatccacagatttaaatgtgagtttcatttaaaaaaaaaaaaaaaaaccttcacagaaacatccagattaatgtttgaccacatatctgaacactgtggcccagccaagttgatacattaaaaataaccatcataggcagcaatggacaaattcatttattaacaagagacgggtgtgtgtgagttcatctagaatttgggccaggtttccatagttactgcctgaaacgtcagtgttatagatgccggagtgaggccacctgtggttctcatccctggtcatgacaaccacatggagagctgtgaaaagatgctgaggtcaaggtaccctcagagcgtcaaagtcatttagtcgagggtggggtcaggcatcgatagagattgttagagaacctgcaacgttcctccatgcagccagggttcagaacctctgagccgagcaaatcctccctccaggatggtgacttggggaggtgagcatgggctttgcagggaggtgggctggatttgagtctcacttcaagttagtaatgggatgctggtactgccatttcacctccctgaaactcttgataaataagatgctgcctagaatgcatgcagccccatcccccaaggaggaaggaggcctggtaggtgtcattgtcccctgctgcctgctcctgccaccccgcatggtgttaacaacttggggtctcctccctttcatttttaagttcctgttaaaatataacaatgatgatgctttatcaataaacgtattgagctttgaattggacactgtgctaaagcaggtattgtcttatttaaccctcacaataactcaacgaggaagattccatgatggctccacgttccaaatgaggaaactgaggcacagagaggttaagcgactggcctggagtagatgctgacagtctgagatgtatgactctgaccgctaaagctttttatggaacttgggtccctgagacgtaaatcaaggttatggccactgaaaaggaggaaacaagaactggcataggttccagatcttgccattgtgttcgtagaaaccctaaaaaaaaaaaaaacaaaaaacaaaaaacaaactcttggaaaattaatggtagtttagcacagtggcaagagacttggtgcatatccaaaactcagtcatgttcctggttaatagccccagtccacagaaatctaaaaataaagagcccattcacaataggaacaaaaataaaatataggaaaaatttggcatgaaaggtgtagtacgtgaatgaataaaactactaaactttattaaggggtcaaagaagattcaacctttggagatacggtctgtgtacatcataagtattataaaaattgtatttctttttaaattacctatagattaaacgaattcctcttttttttccaaatcaaagttgggcatggtagtaatttctaaacaatttgaaaatttccaagtacaatataaagagtgccttctgagttcatggcaactgccaatatctcagaaatgaggagtcagtcatcctgggcacctgagtcagttctagattttatttcagactcagccatcaatggcagtgagatcctttttgcttggatgtatgtgggtgcactcagatctaaattaatcagttacaataattgtgtcacagttttaaaatatttaaattgtgaaacctatcataggtttagaaatacgtatcaaatgtatatgtacaattaccaaacaaacacatgtaaatgaacacagagcccctgaaatctgaaactcttgtgttctgggatcccctgcctgtgagtgtgggcagaacatgtgacctgcctctagtcatacgggggatggtaaaggtgaggggatgtatgtgttccacatatgtgattatgtgtttcgttacataagattgtaacatgagtcttggctgggtgcggtggctcacatctgtaatcccatcaccacggaaggctgaggtgggtggatcacttgaggtcaggagttcaagatcagcctggccaacatggtgaaaccccgactctactaaaaatatacaaaaattagccgagtgtggtggtgcgcatctgtagtcccagctaattgggaggctgaggcaggagatttgcttgaacctgggaggtggaggctgaagtgagccaagatcacgccactgcactccagccctgggagacagagactcagtcaaaaaaaaaaaaaaaagattgtagcatgagtcttgctggagactctctgtcccttgctggctataaagaagcaagatgccatgttgtaagccaccttatatggtagccacgtagcaggaaactgaggagcagcctccagtcctcagcaggcaagagaccaaatggtgctgacaaccacatgagcttggaggctgatccttccccagttaagcctcagataaaactgcagcccaaccaaccaacatcttgattatagccttgcagagagctgtgcccagagtcctgacccacagaaaatgtgagattataaacatctattgcttcatttgctaaattatttgttatcttattattcaccaaagatcaataatatggccactactcaagttaagcaatagacttttaccaacactttagactctctcatgtacccttcctaatcacagctccttctctcctccccagaagcaagcactatcctgatttttgttttgatcgttcctttgcttttctttatagatttaatacctatataagtatcactaaatagaatatgctttgctttgaaaatatgagtatcaagcacaaacgtaaccgtagcaattttttaaaaggtcagtggggtaatttttaacttgaaaatgtgactttgaaattgaccttgaaaatagtaatgacaaaatatcttgaaaaattactataaattatttgtgacatcatagtttttataaaaaagactttttaatgaagtagcaagttaaaaatatctagttgaatcttcacctcacagtgtgcttgtggctgcacacacacacacacacacttatacacacagtgtcacacatccacacacttccacattcatggctgattgatggataaggacaaagtaaaatcacaacacaaaagaaaataaacgtgaatattcttctgacttggtaattaattttctaagatttctaagtttaaaagaaataaaaagtcatgaagaaatttactgatagatttgactacacaaagattgaagtcattttaccagtcagcaacgtaaacattattagaaaacaaaatttaatccatgaggcatatttatgacaaatataaaatagtaccagctcctgaatacacatatgaagagttcacacttcaaagtctaagacatttacgtaaggaaaaacatagccgaataataaatacattaaaaatgatcaaacttggccgagtgcggtggctcatgcctgtaatcccagcactttgggaggctgaggcgggtggatcacctgaggtcaggagttcaagaccatcctggccaacatggtgaaacctcatctctaccaaaaatacagaaattagccaagcatggtggcgggcgcctgtaatcccagctacttggaaggctgaggccggagaatcacttgtatctgggaggcagaagttgcagtgagctgagattgtgccatcgtactccagcctaggggacaagagtgagactctgtctcaaaaaaaataaaaaacaaaaaataaaaaaaaaaaaaacgaccaaactcgcccatgcaaattgaattgcagtgccatactagcaaagtttgtttcaagttatgatgccttaagttgatgagggtgggatgagacaggctgaccattgaaaggaacacaaattaatagaatatttttggagagcagttcagtaaaattattcctgtctttcaaatgtgcatagtctttgtcctggttattccatttgtaataatctctcctaatctattaatcctaaatacaaggtttatgttaaaacacatttaccaagacatttgattggcaaacatggagataatgtcgaaattaggggaataattaaataatggtttactagttgggtaagatgcagatattttaagatgaggtttactcatagtttgtaatgacagaggtaactcatggccacaagttaaaacaaaataaagttggaatcctgtagtagactgttagcaccagagagttttttgtggtgttagatcaggatcaaatccccactatgcacctacttgctgtgtacctttgcggtagttgcttaatccttatgagcctagtatttttgctcataggtttgttttaaggctccaatgagatgactaaatacaggaggtcttgcctattccagacacttgacaaacgtgtcctgcctcctcttgctaataacgctgaacatgggatgatgtgacacagagaaagggacaggatcaaacattacatatagactgattctaaatttaaaatacatgtttgtccacaaaaagtttgaaggatagaagtaattgttttaaactttcaattgaaaggaagtgaaagtgttggctaactatatttccataacagtgtggcttctgtcttggtagggactgtgacaatcttgttcacagggtccttgtccataatcttaaccggtgggaaatctcacaccaatcttattcccttagggactgacgtatgaaaatcttgtgatgttccaccccagatgggaaatagggtttggtgtgatttgggggttgacaaaatgaccccctcacaatcgcaccacctgcaaccctggtagtcaatgtgcattggcaccaccagggatgcaaaatgcagattcgcagagagatttgggtttggtaggtctggaataaggctgggaagtgcgtggtgcgcgcgtgtgtgtgtgttacagatagtaaagtttatagatcttaagtatagagctcagtgcatttttacataagtacgtgtataaccaccattcaggtcaagatattgaccatttccaataacccaaaagcctccttgatgccccttcccagtcaataactcccagccccactccaggtaacattattctaatttctggccctacagagtagttgagcctgttcttgagcttcctataaatggaatcacacagccgatactcttatgtctggattctcctgctcaatgtcatgtttatgagatgaatcatgttgactgtattggtagttccttcacttttattgcccaatatggataaatcacaatctgtttgctcctccattctcctgttgatggacgtctaggttgattccagtttggggctattgaacagtgccgctcaaatgttcctaaccatatctttggctgggcataaatgctccattctcctgtatattcttagccatggaattgatgggtgcaggataggcatatgtctaattctagtagatgctgccaaacagtggaaatccatatttttaaaattgaaaattatttgtaattgacacataataattgtacatatttatgggacacatattatattttgatacatgtaaacaaaggtataatgttcaaatcagggtagtcagcatattcatcacctcaaatatttattatgtctttatgctggaaacattcaaaattctctcatatttgaaaccattatgaaaacaaattatcaactacagggccatagaatgctatagcttattcctcccatgtagatgtaatttagtaacaattaaccaacctctccctatcctcctctccccatcatccttcccagcttctagtagctacagttctactctttacttttctttcttttttctttttttttttttttgagatggagtctcattctgtcacccaggctggagttcagtgacgtgatctcagccactgcaacctctgcctcccaggttcaaacgattctcctgcctcagcattctaagtagctgggactacgggtgcgtgccaccacgcctggctaattttttgtatttttagtagagacgcggtttcattgttagccaggatggtctcgatttcctgacctcgtgatctgccagccttggcctcccaaagtgctgggattacaggcatgagccactgcacccaacctattccttacttttataggctcaacgtttttagcttccacatacaagtgagaacatgtggtatttacctttctgtgcctggcttatttcacttaccatatgatccagtaatcccactactgggtatatatccaaaggaaaggcagggaaatccatttcccaaagagttgtctgcactcccatgtgtattgcagcactattcacaatagccaagatatggaatcaacctgtgtccatcaacaaatgagtggatgaagaaagtgtacatacacctcggaatacaaatttgaccacgagaaagaatacaatcctgtcatttgtggcaatgtagctgagctgaaggaaatccgtatttttataagtcgttacagataggggtggtcttggaccacactttgagaaatgcttcttggataaaagccccattatatggacaaatatatttcctttagtcctcagttcaagtagagaagggcttgtttatacggagataccagctaagtgatttggggaagtggggagaatgagaaatcaactgagtgccacccattagcaccccttcggaacaaattattgcaatttacctcttttgcccaagagaaagaagctgagaacagagaagctttgataggatttgatagggagagtgaggcgccaggccaccgtgtccagttaaccaagcctcctcccaccctggccatgagctagaataatgctcatgtatttgctggttaaaggagatggcttggggacctgggttatccctgcagggagcaactatctcctctgctcatcttaaacaagataattgcaaagcggttccctgccagcccatcctcttaacaaagaaggtgagataaaagagatggcattcctcctgctgggcccagcaggcttgacaaccagtgccagtcatggggaaaatgtccctttcagccaactcgagatctttcaaaacagacccaggcagtttctttgagggctgaaagccaggaaacgggttcctgttggccgaggcttggaaggagggcctgcctggtccgttggcccataccaggcttccttagcgcctctgctaggagccagttatcctgcaggctgactcagcctctgcccagccatgatctgaagctgctctctgctgttttaagctgagcactgcaaccagggacctcagacaccagagacaatgcaggcctccagaaagcaggagaaggacttctaaatcaaggctggcaggaggaatgggaaatgggcattcaaggacatggcagtatgctatgctctgtacatcaggacctcatggaaaccagaaaggtaggatgataattcctatccatgccaggctggacctcatgtccctcatcgggctcccacagctgtgtgagcattctttaccaacgtggcacttctggaatcccttgtttaccttcttctccactgctctataaatgtagtgaaatttccaggtgtggtggctcatgtctgtagtcccagcactttgggaggccgaggtggaaggatcacttgagcccaggagtttgaggctgcagtgagctatgatggcaccactgcacttcagcccaggtgacagagtgagaccctgtctttaaaaaataaaataaatgcagtgacacaagacaacctatgtctgttttattctcaaagctgcgtgtgtccccaaagccaagtgaggtgtctgggcctagttaatgaccaatgaacattggctctgaaggagtgaaattacaccactcgggcatattgacactaagttaaagccacttgaaaaacagcaggtgtggccgggcgcggtggctcatacctgtaattccagcactttgggaggccgaggcgggaggatcacgaggtcaggagatcgagaccatcctggctaatatggtgaaaccctgtctctactaaagatacaaaaaaaaaaaaaaaaaaattagcctggcggggtggtgggcgcctatagtcctagctactcgggaggctgaggcaggagaatggcgtgaacccggaaggcagagcttgcagtgagcggagatcgctttactgcactccagcctgggtgacagagcaagactccgtctcgaaaaaaaaaacaagaaaaagaaaaatagcagatgcaagaagatcactctgaccttcatgccatttgttaaaagcaaaagatgagatccctatgtgaaagatgcaacagtcttattctcaaagatgagaagctaagatggaaagaattctgtaccaaccttgtgcaaataactcttaccttttaagcctccccacatcatttagttgcttcttcacaacttactattatttgtccaattcagtatatctgactacttcttcaggactttatttccttatgagggtacctgtgctacataaaacttgtatttaaaaatgtgcatgctttcctcctgttcatctgtcttatgtcagttaaattctccagcacaagcaggaccctaagagtatggaagtggaattttgctgcccctacagttgattacatgagtgaataaatgattgagtgaattttgaattataacgaagaagctaaatatctcagtcatggtttttcttcctaagaaaattaatctgttaagatcacagagttgtaacaacagcaacaaaaacctagctctttaaaaataaaaaggaactcttttctgaattagcaatgtccggagagatttttggttgtgacgactggggcagggggtactactggcatctaatgggggccagggatgccgctgacaccctgcaatgtacaggacagcccccacacaaagaactgtcccacctgaaatgtgagtagttggttgtgctgaggttgaggaagccaactcaaggaagtcacctgccggagggatgctgttgacactgcttgctacagcaaaagctgctgctgagaatgtgctccagttgaaagcaaagactgaaaaactgaaaagagccaggcgcggtggctcacaccataatctcaacactttggaaggctgaggtgggcggatcacttaaggttaggagtttgagaccagcctggccaacatggtgaaacctgtctctactaaaaatacaaaaattagctgggcatggcggcatgtgcctgttaatccgagctactggcgaggctgaggcacaagaattgattgaacctggggggcaaaggttgcagtgacctgagattgcgtcactgcactccagcctgggcaacagagcgagactccatctcaaaaaaaaaaaaaaaaaaaccagaaaagaaaggaataactgaaaagagcaagagccacttagaagccagatatggtggtgcgtgcctgtagtcccaactactcgacaggctgagatgtgatgatcccttgagcccaggagtttgaagctgcagagagccatgatcgcaccactgcactccagcctaggcaacagagtgggacccaagaagtttttttaagccacttagagaaggttttacaagttacatgagcaaaagctaaataactagtacatccatgtgccataaagtgaagaaacggatgaggtctctatgggacatgtcagctaaacccaagaatgtgtttgtttcttgtggctgagacagtgatcaaggcagctttcctcccagggcaaagactgtggtttgtttgcggccatttaatttggcaaaacctgagttttgatgaatactttgcaatcttcaaataatattcattttgtttccaaatccaatgaactagaggctgtaattgaaagaagaagaaagggagggaggtaggacagagaaaggaatagaaagagggagggcaggaaggcagccatgaaagaaggcgtaattgtcaaaaatccaagttatttgaggcatactgcttgacctgactttatgcagtacaaacaaaatcagggtaagctagaattcagaagacaatggtaccactgtgtttctctctggagcgttctcagaagtgtgaccttttctaatcccaaactgcttaaaaaatgatgtctccttggggtgccatttagattaatctgtgatgggaccagaagcgagctaagctgatgattctaattcaattgccagtgaaatggtgtctgtctccatctgtaaacgtcctcatcctgctctcaatggggccacattgacggctgcagccagcattatcccttacaatccttttaattttttggctgcatgatgtgatcttctgtgaaggcagcactagttcaaacgaagtatttcttatacaagagcacgagccctcagttacgttcttaagaactcattccttgcctgtgtgcctaaaccaccctagctaataaactcccctcaaatgtggctttcctcatctcaccagcctggtggcatatgctggggtgggggcgtgtcatgccattttatgcatgggggttcagggtctgtgattaccttgtccaaggttaatcagtgggtgagaagcaggtgcaggaccccaggctattctgttcacaagggtagtgcttttttcatcagacaacacacatctctatggcagtgtccaaatggtgcctaacgtagaaggtgggccccgaaagtgcacttcagtttatactggccactcagcccgcatctgcttgcagcaagcttaaatgtgtctgactgcggccatcttggctccctcaaggccaccaaagcaagtcctgtggttgcttccttttgctattgcgaagccccttcagagtctactttgtcctactgcagtagcagtgaggcccgtccatcagggatgctgggctatgaaccgggcttcttgtcttgcagccacttccatcatcccagggatacaagttactccaaacctagcttccctgcaattccatttcccacaccaaaacatggaaaggataatgctgacatcccaccagggcctgtggggacaaccgattttgttgtgtgactgaacagctttgccatcttcaagtccctatgaaggcacaaaccctgatagccatttatatgtaagacactagtatgatgagcaaggaggtttttatccttcttaaaaaaaataaataggggagtggaagagtggaatggtcattgtaccagatcaggttataatcgcaaaatgctgcaacagaatctaagtgaaaagacccagtttagggtccctggggctagcctggctcatgggacaagaaaacgtgcgtccttggcatagggtatctaatgtcttgggacgtctctggaatgtttcatctaagattcttttttccttttaaaattaattagctgattaagaattaatcacatgaactattaatttgtattgctatttattaaaatattaatatttacataatttattgatataatattcaattgtttgataggtaattaatacattccgactcacccagcaagaacatttttgtggtgacaaggtaaagagtaggatgacaattggatgacccaaaacttagacctcagtaagtgaaaaacgtgttgttatcaatgctcctaacttgtatcattatctaacaagattttccaggcagtggcagctttagaatcctatcttctctcagtttccttttcctagtagctgccagttaggatgccaaccatccctgattttatgtaggatgatgatagccaggggcaaatgaggaagactcacagaaatctaggactaaatataagaattttaaaaatgggagatttttatggtaaagaatgtgaggtttgtagttttttaatctccacaggagaaatgaacaaatgattccatgtaagaacactggaagatactaaattccaccttgatattttccaggaatgtcagtcacatcctcagtcttggttgacttcctgaaagtgtcctctccagtcttgagggacctcctgctccaggaagcctgccctgatgtcccagccagagatggtcctctgaatttcccctggccttcacctggcttctctgggagcacagtcacaattcattgtatattatcactaattggatacttatttcatgtcctgtgttcacagtggtaactagcatgtatacattacttatagtttgataacagcctttctttcacatctactaaaacaatgataattcctaatattaattatatttgctgtgggtcaagtattcatttagggctttacttggagtatttcatgtaatccccacgcagccctgtatctctactaaaaagaggaaaaattagctaggtatggtggcaccacctgtagttccagctactcaggaagctgaggcaggagaattgcttgaacctgggaggcggaggttgcagtgagccgagattgtgccaccacactccagcctggctgacagagagattccgtctaaacaaacaaacaaaaaaagctttgctactctaagcactaaccgcttcctcctccaccttcccttctcagctttccttcccagaatgcagatgctatcctggagggcgagctgcccaaatgggatgtggaggcagcagcatgacgacaaaagatgcaatctgaagctggtggagccacaggacgggagctggacagtgagggtttcatggaggccgtgcacaggactgcccccatctgcagggacactgtggttattcagtcttgctgtgcacctaagggcagttgccaagcggtggcagctacaaagctggggaggggctctgtgaaccagggcctcctatggctcctgttgggtttgggccaatgggaggctccaagatacacctcagcctcgcactcttggctcccattcttggtgggtacaggttccccccgccttgtgtctgcaggcctagcactgggaacgacttccttctgagctactttctgagtgcttccaccccttcctggcttccttaatcctacctgcgcctctccaaagggtcccttcattcaattatcttcagtttaaccctttgagctgccatccatttgctgcacacagggacaggtggctcactgcttcacaggcagcaaccatacaactgtggcttgtcttcctacgtcttctgcatctgaaataacaaagaacttccatcagggctcagtgtcaggcagaattaatttcaagtctctattttatttacttcctgcaggagttcaatcatttgcccaaaattacccagctggtaattgtccgtttcattgtctgctacatggggatataacgtctactcctcatagaactattgtgagaataaagtggaataacaatgtatgcaacatggacagattttgttaaaaaaaaaaaacacacacaggatgcccagttaaatttaaatttcagatcaacaatgcttttagtatgtctgtgcaatatttgggatatacttgtactaaaaaattatttatctgatattgatatgtaactggatggcctgtattttattactttatttacttatttatttttgagatggaggatctcactcatgttgcccaggctggtctcaaactcctgggctcaagcgatcctcccacgtagttgagattacaggtgtgtgccgctgtgtgccgctgcacccagcctatcctgtattttatcaggtgaacctaaatatctgtgaagtgcatagcacatcgtctgcacattacttagcctctagtgaatagtagaagctaatattattataatttgtaattcccatattactaacccctaacctaaaacaatacctgacataatgctcaaaaaaacagcaaaaatgaataaagaaatgaacaaatggagaaactgaaaaccacagaggcattttgtctgcagcgaaagatgcccagctgacaatggcagaggagagtctggaatttaaatgtccttgattcgagcccagtgttccttcctccaaatcgcattgggaacaaagtgaaaggaactgccagaagaggcaggtgaccaagacatggcagcgagtagatccccaaagttgctgaaaaaaccttttatcttttacccatcaaaataattatgtccttatttttaaatcagtttagattacagactgggactgaagcttcctatcaaagacatttgcagttttgtatcagtctcagcaatttcatgtccatctcagcaatcaaacatttctccattttgtttttgctgcagtgtaactgcattgagaaaatcttggtttgggcagatgagcacttgcaattgataaagtatttttaaaaattcaccttgcaatccaaggatactgttaatagagatgtcaggaaaaattatattcccagatcttttccaaagcaactcaagcttagcaaggcaaattaacgtgtcaaggatgtattatattagaatttggttcttgaagagtgggctggctctcttctcttccctggagcaatggagtcatggctgggcctggggccacctaaccaggggctgccagcctcctattccagccacctgcccctccaaggtagatatgctcacctgactaacagttcctcctaaaatgggagtggacatggcgggggtgtggccctgaagactgcacgtgtgcctctgccacactttctgcctcttctcaaaccaaaatgtagatgcaactcagcctcagcctggcaaacaagacagatgatgggaaagcatgaggacagacacaccccaggacctggaatattcatttggaactgcaagttccgtgagcctagtgggttcttaacagttaaatgatgtctctgtcgagattggtggtaacctgtagaaatgtgatttttaaaaatactttccaaaatttgtccacatttgaaagattagcataactcaatgaatcactttttttcaaataatcaaataatggcacaaaattgtgcacagataaaagttgtgttccaagtggattttgacaggggggctaaagattcattgatagggtttcagatttcacactgcatgaacctttaagaaattttcacttgttggattttggtatagtgccaaggataaaaatccagttctctgaaaacgctattcaagttcttattccttttccaactgtgaatctgtgggagaccattttctttatgtatttccaaaaaaaaaaaaaatgtatttcacacattgaatggagaaggcagacgtgattttccaaaatgtaaaacaatgttactcttctactagtgttttgaaaaagatttttctttaaagtttgctatgataacatgtaatgggtttgtaattggtagagacattaataaatgtttaaaattttttgtctttccatttttggaaagatacataaccaaaagctctttgggggtcttcaataatttcctagtgtcaagagcaccacattgtactggtttacagcacaaaggggcccccagctctcagaggtccagatacgacacatgaggttctaacaggctcagggtcaaacactggcctaaggttgaacccaagagatccttttgctaacacagtaatcatttgaagaaaaattgttatgctaaacaatgtcagtttggtgatcaatacatttttgttaatgcagtgatcagctgtaaatgtgaaaactctgcagcagggattcgattccaccatatcctgtcagtctgcacaggcatacacacacacacacacacattcacttctcaaaaactgatccaattgttcaaatgcatgttatctacatgatcatttcaaaagggcagtgccctaatggaagcagactttgttctacatccccaagaagctcttaggatctaagtcttctagttgagcttcttctaaccaaaaggtcggtgtgtcagagctggaaacagaagccaacatcccttaagtctggctttcttctcactacactgcttcctctagggcgagtgccaggtctgcaagtctctaagctgaccaatgagcatgacaggagatgcctgcaccctcccctcccctctccatccacaggtgttgatccttgctggtcataattaatctcagatcaatgtcttgttccactgcagcccgaggtcttggaatcctgaacagtgttccaggtagccaaagctggtctgcagaatgaagctgatgtgcacaaagatattctgccttcaacggaggtgtgaggatcagctccgtctgggtcatgcctggagtccagcttctctcctctcccaaaatgactccgatttggtgctcaaccttgtgatcacagattgccaataaacgattagcttgaaaatgctgcctgcattcttctctctccagggataaaaggtggcttgagttttctcctttaaagtgtacttgtgaatataaagatcttcctccctgaaactgatgcagatcctgggtagagatttttttaagcctttaatttcattgcatgaaggaacaagaggtacctcccttctgccatggatcttctaagcctcagggccttgtttgtaccttgagtctgtggctttttttcaaaaatggagccacactatctgcattattctgtaacttagtttttaatcacatattttgaaaactttcccatgtatggacataatatccatgaaaaaaatttaacctgtactaaagataaaaaaatttaacctgtattaaagacaaattatgtcaggtgttaaacaaacacaccctttggtctagtacatgttgaaagtttttgtgccatttgtcttttttgattttgggactggtggtttttccctcttcaacagattttaaaaatacatagtcaaatatatcacttctattctctaccatttttgtcattcttagaaacactagcgtttgtgtggctaaattcagtattttcttgccctcttacggtttttgctgcaaagacaaggtaagcaagactatttttgtcacccagttttatcatcaccatttactgaatggttcaccattcccattgatgtgaaaagtaccttcttcctaacccaaaatacacataggaacaaagtcatttgtggacttttaattattaagaggcagccccagcttcagatgttagagactaacattttatcccctgacttttctaagaagcagtatccttagactcttcgaagactttttttttaattgggattgcacatttagacaactttacaattgttacaaaagtacaaaaggcagtttcaaagaacagtgcctttcactttgcaatgaatttggatgtttgggaatttgatttttaacatctaaatgcatgctattccttacctgaaagctatacaggctgctaagaatttgagaagtagatgggatgcagacatcatctggtccagtgttttcagttgacaaagaaacttaggctcagagaagggcagggatgtgacccaggtcagagggtgatctggcggtatggttgggagcaggaaccgagggttccagccccttctctggggcttcccttccaccacatgatggatctgacaatcctgtgttccaaacatttcctgcctgaggctgcagactggtaagacctctaaagccatgaaaatcccacaaacgttcctccccacccagccgccccacacacccccatcacacaaagtcagtgacccacagtgaagagaaaagatatttaattatttctcaggctaatctcttaaagcgctcaaagtgttttcacaagtgcaaggggagggattgttctcagccaacatttaccagtgattccgacacacgcaaaaacactcccaatcacggtgctttatacttacttttaatttctgcactgaaaaagaaaaggaaggtaaaaacaatgacagattagtttacagtgacttcatctttgtccttaaattaacctttgctcttgagagcagaagagggaaagacaggggaacatcaaagcatgatggtgaaacggtgaccaggacacctcggtctggctaacaagggttctaaaaacttggacacggtgccgtcaacgcactagtttgtaaacactgacaggcaacagttaagatacattaaaaaaaaaggaaagatacccacaattccattcttaaaatcaagcacaaaatctgacaatgaaacatatccaggggttgtgtgtccccatctgatctggaggtggcgctctgaaggcagccacaaggtgtgagtcacacactagggagacagacatctgttcaacacagaattccggctttgctgaactgcaatgcatattccctcttctcactagtacagaaatgttctgcaggcaggaacatgagccccccggctcattcacctgtacaacctcccctgacagatagtgagagccgcggcggggccaggggctctgtgtgctttggaggctactgcctctggaatgtttcgcattctcaaggtttggttgggctgtgggttttagttatgctccacacattgtttaggtgctcgctttatttttcatgtgcaaactgttactgtctaaagctttcagaagaacgtgtacagacaccctgcagagacgagggtcatgactgggccctcctgcctcttgtggtggggtgggggcatgggggcgcgtcacagaaatagagaaatgacatgttccgctgcagttaaactctagtccctgattcggtccatccagaggcgggggtggggctcctcagtaggtgattgtccactccttgacagaggcatcatgggaggtcgtgaccagcgtgtgctcgtccagccaggccaggctgctgacatggtgcagccggtgtgcatctgggaagaaagggtgcaatttaacgaaaagccaaacttctctgcaactatgtacatcttggactaggaagatggaacaacctgtgcctaaatcatctccagggccaagaaaatggccacgaatcgttgtaactcaggagcctggcacggtggcagtgtggctgaattctccacgtgacactcctgaaccccggggccgggtacctcttttttgtgtgctgcagggtaattagcagcatccctggctccacctacagatgccagtggctccctctctccaagtcttgacaaccaagttccacaggagtgaaataacaatgtcttcttatgtataaaagcgatgacatgcagacaccacacaaacagctacactgtatccatgccctattaaaatggggcaggcatgacaaccagtaagaggctggaacacacaggactgggggggccactgactttcccctctgtgacagtcacaccgtgggtgaacagattcgattccccataatcttgcctccacccaaccgagatgccaatagtgagacggtgcctgtgcgcttatggctcctctgtggctagctctgcccatgaagcccagggaggctcccagctgcaggcaagggggttcccaccagctctctgctccccaggtccgggtggcccccagcctctagatctgcagccccacctagacagggtgagattcagcccccacccctgcctggcacggcatacatcctgatgaaggaagccttggcctgcgggtggcacaggtgcccaggagcgccttcaaccaccaagcatgacttggctgtgaggccaggctttagcactctgtccacatcaccaggctggctcttttccagatgcagaactcaactatctgcacgagaacccgatgctgaggtcacttcatgtttggtggcctgtgacctcacagtgaagacacagaccccgacctcctaatctctatctgactagctcttgctgtatttttttctggatccatttcattcatgaacttgtttgattctcactaccagactggcgattgccttataaaccaggacggacgttgaaacctgctttgtctctcctcccttccagaccgggctgccttccctctttgcctgtcctgcacctgaagcctgcagctggggaatgggctctgggggtgggctcagacatttttaaataggaaagggccccattaatgtttaacacaaaaggatgtcttcaaggagaatggatgaggggacttgactacacactaggaggagagtggtaggggggcactcggggaggggagggtttggacaacacagagctgccttacaatacgtgcatggccacgcggggacatcacaaccccctcagggagaaatgatgacatgcggggctaaataaaacctactgttacaaatcatttcacctgtttcttttttaaatgtggctaccaggaaatttcaacgccacatgaggctcacattatacactggacgtggctgtcttagggagggggagaccctggtcccaggtgggatttaaggggtgagtgggggaagtgaagatgtcaaaagtgaggccttcactcagctcagcaggtgtcctgtgcatggggcccccgtggtccctcagtacggccagcagcgcagctggtgtttgctggatggaaggagacccacaactcttccgggccacctgtctagaagcacagaggctacttagccctggggactgaagccaggggacagcctgtgaggtggcccatggagccccgaaccatgggtggtccctgccaaggcctgggggcggaagtcaccttggatcttgactctggtttccgggtcactcagggtccaaacatacaccatcatgtccatgccaccggaggcaaagtgttcattgtctggggaccaggccaggcagacgatttttgcatggtgtccataaaaaacattgttctcctagttgcaggttgaaaacaagagaggtggcaggtcaggttcaggccgcagttgcccatatcacctcgcttatccctcatggcgacaataaggaccgaggtttctcacgcgctaactctatgccagcgacccctgcaaacccactgactcctcagaagcatggcacgaggcacctgctacttgtagaggcaagaaaactacagctcagacaggctcagctcaaggtcaccaagtcacagataacctcccactgccacctgcaccgcccagcacggggacagaggaggagcccgccgccactcaccgagtagccgtcagcaacgctgaacactgtgaccaccttgctggcgtcgcacaccgcgaggaaggcgccgtcgtgggagtaggccacgtcggtcacggggcccttggcctctaggagcttgccctcatccttcagcgtggtgcccaggatggaatacaggcggacgttgccgtcctacggcagggacagagaggaagtgagccacccctgaacacacacaccacacccatcctttgtgaagggggggtcgagggcttaagaaactgtgccgttcccactgactgctgctctgctgggcccatgccaggagctgggcatggctcttcccgtggatgggcctgaaacctacgcagctctatgaaaacagctgttggtacctcggggcaccgctggtctcatgaggccctcaagctggctggtggaggaagccactccatgccctggtcacatccggcacctgaaggacctggcagcacatagacccacccagcccctagcatggagggcactgccacgcctgctgcaggactgggttatcagagggctgccctcctgggctggagaggggaaatgagctcttctacagagcactcaggacttggccaggcacactgtgaccagaccacacacacaaattcaagggcatgagaattatgccgaggcagaactcaagggaaactgtaaaatgtctggttagtaccgcaccttgaagatgctgggaaacttctgtcactcttccttcaacctgtgagccgagcccagccccaggggatgccattccttgatttcctgacctgctaccctcttgcgctcccctcctgccgccactcatggggctggctctgaggcacagctgtgccctcctcggcactccctctacctcactgtccacagtcttgtgggcacccgggcagtgaggtgggggaagtgccgaggaggggaggggaaggctccagccctgggtggcaggagatggcgtggctgggccccagagcaggtcccacgccccgactgcccccatccttcccctgacccctcgccttccctgagacagccccggtactcacacagctcacactgtccccaaatcacccagataccaaggacagagagcacgggggagaggaaagcgacttaccacacccccaattgccaccgtgtccccgccggggtgcactgccacaacttcgggctcgtagccggggttgtcgatgctgaagcacttcctctgatccttcagcaggacaatctgtggcacacacaggcagctggtcaggcggtccagcccttcgggacaaaaccctcagtggtaggaggggcgcgtccctgtcggggctcactggagctgggtttggctccatacccaacctctttgcagggccacctggggctctgagccacaccacctggactcatgtcccgtttgacagttgctctagccagtcaggtggggcaggaaacacaactaactgtgaccattactgtcatcactacattacttccaaggcagtcaccacagcaccacctcttggaaagtcacttggcctcgatgggaatcaacgttcagggtaagaaaggtactaacaacagtaaacaaaaacagcgacagcccctaggcacgtgccagcgctctgctgtgagtgttccagccccacaaggcagggatcgggttccccgtttcagagaagaaaatggggtacggtgcttatgctgcacgcccaaggctccagttcccacaggctgagccgggactcgcccagaatccaagcctcggcacccgcactgggcctttgcctctggtacatgcagcagaggctctgcagcgggggccttccttccatctcccttccttgtcaattcttccggttctaacttactcaactgctcccagacagtggccttcatctctgagttttgcctttatcccagtgtgcccctacccaagccaccagctgtcatgagggaaggcagcctctgcccctaccgtctgggcttctgtttctgcgtggattgtgggtggatcgcgatgaatggtagcagcaccctgactaaaacctactactgaagaggcacctctgtcatctgcccggctctggaggtggccttacctactcacaggtgaagaatgagggcctaagcatttgcctgaagcttcgtccgacatgagacttgaacctggttgtttcctgatctaaaatcccaggcccctcctagcaccctcctaactctttgactggtgacagggagctctgcagaaaattctgacccagagcaggggttccagatgccctgggaggatcaggtaacagcagatcacagagaaatgccacatgaggaggtgcagagacctggagcctgtcccctgcacaccacaaccctaccggggtcctttctaacctcctgggcagcaggcgccagctgggccagtctgaacatcctctcagcctcaggggaaagggtggcctatgatgaccacaactttacagatgaggaaacctgggtctggagacacagggcacgctgccctaggcctcatcccctcacccacaaagccccatgtgcagaccccttggctgggaagagccctgctgtgcagagataggccacctgccagccttctagaactccgctttgtagcgtttcccccaggccccgaggcgctccatgtgtggattccctttgcacctccccacccccactggctgtccaggctgtttgcaataattacttggcagggatttcttattatctaggacacagagaaatccactgtccctaacgcaattaagttcacaaggcaaaggagggccagagggtgctgaaagcagctttctttagcagggctcgccactcgtgccaacaggtgccccttgacttccccggtctacatgccagcaagcctaggcccgccaacagataatatcttctgcagggcagaattctgtataaagtgggtcaggcttgggtctcaggtggctttggtccagatattccaaaggtgtgcaggtggccccactgtctggggttagaagccaggccgggaagtcaggtgccacccttctgcatgtgggaaagtaccaagctgctctaggcctcagcctcctcatctgtaagaggaaccaagatggtgtaaggagacttacatgtacttcctcataatcacctggatctgtgagtgctggggatgggaaactaaggctcagagagggtgaggtaaatgccggaggtcacacagctacaatgcagcagggctgggatgtgaacaggagcaaaggcaggcccaccccacagggtatctcatagactttacaggctgacaggcaggcagcgtggtctgaggcttagagacaaatcccagctctgccctccgaccagctgcggccttggacaaccaatttatccattccgtgcctccatttcttcatctgtacaactgatgtgatggtggtgaggattaaatatgtgagatcccttagtgcagtgcaaatgagcactcaaccaaaacactggctagagcaactgtcaaacgggacatgagtcaaattcagcaagcaggcaccacacagctgcaggctcccacccaaacactaagccaggtccctacctgtccaatgcacacgaccacggcgtatcccccggggccgacggctacgcactttggctgaacgtccagtttcacaactccttgtccgctgttagagagaaaggaagcacattacttcgacaatgcagcagctcagggtaggtatgcatacatatttactgttaaaccacagttttgctccttagaaggcaattctattgccacctatactggagagacttgctaaaatatgggatggtagcgaaaaaacgatccatgactctggtgcaaagagattataagtcataatgggggcccggggaggggtgg

SEQ ID NO: 8 - DNA, 78240 bp, Artificial Sequence
  Based on Homo sapiens sequence
acgcctatacaccgccaaatcgctaggaagccacgtattcacgaagccacgcagtgacgtcgccacgcacgtacgcacgcacttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaggatttttaagcccagagctgcgagaccagcaggaaggaactgggagaaaccaatggggaggggatgggggcggggctgagaggaggagggcggagctgggggaggggaagggcgggagtgaggaaaccgctggggcggggttgagagtggggcggggacttgaggggatggggcggggacttgggatggggcggggactcgagggggtggggcggggctgagagaaaccattgggggcggggctatgggcgatctgggcgaggagaggctgcaggaggagctcgcggactcctgagaaccagcgcggggagggagggggctggtgagaggaggaaggtggggctgaaagaaaccagtggggaggggttgggggcggggctttggaagctggtgctggagaagcagggcagggctgggggaggagtggggcggggcggggttcggggggggctggggctcggggaggggtggggcggggctgagggaaccgccggggaggggctcgggggcggggctttgaaaacagcctttggagaagcggggctgggggggcggggcagggccgaggggaacctctggggtggggctggggggtggggtttgcacgcagccacaggagaaacagggcggggctcagaaaagggttggatcgggctgagagagaccgctgaggggggtgctgggggcggggctttggaagcacccgcgggagaaacagggaggagatggggagaggcggggctcggcgcggggcggggcttcggaggcagccgcgggagaagcaggggggggttcggggcagggcgggtctgagcgaagccattggggagcggctgggggcggggccttttaaccagccgcaggaggagccgggtggggctggggcggggcggagctgagagaaaccgctgaggatgggctgggggcggggccttggaagcaggcgttggaggggcggggtagggccgggccgagagaaaccactggggagggtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatccccactcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagccaaacactctttgggttcacgctgtgctgttcagtcactggtccccaccagcctgctgttccaggtctccctgctttgcaccggcggttcccatggccttgtcctggtgcgctcctggcctccttcaaggcacaactttaaagtcaccttcacagccccactccgagtattagagactttcgtctccagctctgatagcattttgtacctcccctgtccccaccctacgttaggctcttgcaacccagggtggtaattgctctgtaagactgtggctgccgcagggtctcttgagttccttgaaggcaaggccggtgttttactcatttctgaaactgggtgcccagggcacagtatctgcttagtaagtgttgaatgagcaaagggcagctttcttgttttttctagtgagatgcgcctacttctccctggagaagcttgaggaagcagaaatgctggagatgaggtgaggaggagagggtccctctttatgggatgtaggccgtagggctgcaggggaccttcagatcaccagttccaagtcctatgtatgctagcatcccctcctgggttccttccccacaagaatggttgccagcttctgccgaacaccccagaatctgcttagagtggtttcagatcatgaatgaggatccccgggatggtgggtggccgttgctcctcccgtggcctcttgtttgaagaactagaactcgcataatgagctggatagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactgaactgacccccactcctggggccagcggtgtgtctcctcaagttctgcttgcttcttcaggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccggtccatcctggtggccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctagagctgtcccttgcgaatttgccatcaccttgcctctctgtgctcagcatccccggctgtgcagtccttctcttctgcccacatgctcccctagagaagcattctttttgctcagcctaatttccgtgcaactcctcctgttttctgagcctgtcaccgccttcctcttcctttgcctccccactgacactttccagagtgcagccacctctcctcgctgtgcttttttgactctgaggcccaggaggaagttgcccttctctggagatggttcacgtttgatcctgcctagtgttccggggcacggccagtctgggaccgctttgaccctgattcatggtttcccttcagatgctttttggtcagcctgctttcctcgtctaggaaatggcttttgcccatttttctttttctttctttctttttcatttttttttagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattgtaagtaaccccagagatcatggagtgtcccactgcccctccatctgaaggctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagaggaggaggagtaacaaaggaggaagaagaggaagaggactagaagagcaagtaaggaggaggaggggggagtaggaggagaggagaaggacagaaggggaaggagaggcagatgtggaggagaggaggtggaggacaggaggggatgagaaagaggaggagaaaaggagaggagagggatgaggggggaggaggaagagaaaagaacaggaggagaagaggaggagaaaaggaggaggagtgaaagaaaagaggagaaggagaggagggggggaggacggggaggaagggagaaggagagaaataggaggagggaggaaaggaggagaggacgagaggaggagcagaggaggaggaggagaggaaggggaggagatttggaggaagaggggaggtggaagaagaaaggagaaggcggagaagaggagaaagcagagaggaggaggctgaagaaaggaggaccaggaggagaggacgaggaggaaaggaggaagaggaagagtggaataagaggagcagaggaaaaggaggagggggttggggaggagtggagaggagaggaggaggaacagagttggaggaggtgaaagagaaaagaggagaaggaggagaggaagagagaaggaaatgagaaggagaaaagtaggaagaagaagagagaagaggagaggatgaggaggaggagaggagaaggagagcaggaggtgggaggaggaggagagtaagaggaggaaatgaggaggaagaaaggaggacagaaggtggagaggaggaggagaggaggagaaggaaacgaggaggaggacgaggctgcaccacccttatcaggttccagttctcggtgcgccccgttctgcaagacactctcctgtggtcagccctggtctgcagaggattcccgcgctggatctctgaaggatgctggcgccctctctgcagcacattcctgatgcccttgctgacacgtgtcctctgggccctctcctgaaacctgattctccggggtgtcttctggcctcacctcttctgtccagttccagcaagctcactttgcttagcctttgaatcccttccttcactgtctgccatgacagttcaggcctttcaccgtcactcaggcctggaccatcactgttgcccatcccatgccatcaacaggtttgccccatcccttcggctccctaccagggcattcagttgtgttgagcagcagagtgtctccaagtccccactggttgagctgcatccgggtcccatcccacagggaccccctggccgctgcagatgcatgctgatcctgcagctcctcgagggtgtcatcgctttcccccttcccagacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggtaggtgcacactcatgtctttgttacttgtaagggggcatcttacaggcaagaggagttaggtgaatgtgaagaggaaggaactactctgggcagggggctgggggacgcttcgtagaggagggggtgtttgagctgggccttgaaggtcaaaagggttttgttaggtgggaaatgggggaaggacagtctgaaagggttaggtacattcaaggagcccagagaaggttcgtggctggagcagacgcattcgtagagtgaagtcatgggagagaagaggctgggaaactagattggttccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttcactcgagagatgaggacactgaaattcagagaggggaagtgatttgcctcagcttgtactgtaagtgatcaaggcaggactcaaccagtctttttgaccctgactatggtgatttgatctctacaccacaagatggtggtggaatggtggaatatggtaactagaaggccctttctagctcaggacacatttgatgctgtgactgtttgggaattcagtcctgaccaatttaagaggttgtgtttcttagctgtctctggctcctggtttgcccagtttgattctgtgcctgcctagcaaaacctctctgtctgtggtctaagaagcctgacatctctgaactagtcctcttcctgtccactcaatatcgacagaatctcatggtatgtcctcctggctcagccatggaataaagccagctctgttgtttttgtccttgtgttgtgccccagcttaggaagaataactcttcaggctgcctctcccatgctaggtcacatgcaggtcacacattcccaggtaaattttgcactttgtttatctggaatttgtcttaatttccttgtccttgtttctgattgtgtactctcttcccttctgtctcattatctgggccctatgtcttttctcatggtttctcttctgtaagtctctagacccgatgcaagtacacagtgaagtgaatgaagttaaagataaagcttcagtgtctcttgcttgaacagccctggaaggagccctagcattatggtcctacagttgtatggtttggaaaatctacaaaagatattttaaccacagttggttcagggaatctttctttccactatgctgtctctatccctcttgcctgtgtgttgggtagcaatgcaatgaccatggtcatattgagaattcaactaaggggacattaagttgggattcatttagtttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacctgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaactataacaaacaagaaaagcaggaataacatactatagaagtgcatgaggcagttaagtactaaagataagtagctatttatgttatttttttctaaattttcagatgtttctaacatttgtcaacgttttcaaatgtgtgttcttttgttttttttttctcactttaaatatttgcttttgttcccaattttatactggtaattttgcattcttatacttaaagaaggccccagatgttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagtttgtaaaataaaggggctggatttagtgctctttatagacctttctctctcagatatttcctgagtttttcattctagaaatgctggaatcatatatttgtaactgaaactagtaatcttcttgttcttgagtcttcttcatctctaaagtggacataaaatacatacctctcgtggttgttgtgaagcccgtggcactattcatggtagagcaggtgatcaaaagtcgcttgcatccttctgtccaattgggaacaaaagctttcatgtataattctcacacctctcccttggaatcagacaatcttatcagaaaacctaaaaatttttttcaatcaatttagaagtttattttgccaaggctaaggacatgcctgtgacactgcctaagaaggtcctggtgacatgcccaaggtggtcaggccacagtttggtttttagggagatataagacatcaactgatacatgtgagatgtacattcgtttggtctggaaaagcaggacaaatggaagttggaggacttccaggtcataggcaggttcagaaattttctgactggtattaataattggttgagttattatctaaagacctggaatcattagaagggaatgtctggtttacgataaggagttgtggagaccacagttttatcatgcagatgaaacctccaggtagcaggcttcagagagaatagattgtaaatgtttcttattagacttaaagagtctattgtatcagtcttaaggacagtgttcatgttgatggtaatgaggcatgtccgactcccccttcctcatcatgtcctgaactagtttttcaggttaactttggaatgcccttggccaagaggaggggtccattcaggtggttggggagcttagaattttatttttggtttacattctttccttctggccaggatttgccagaggcaacatcaatggacaaacttttattttgtcccatagcattgtggaggtggtttggctgcctgccccaggtccatcctgtcccttggtaggatctctatggccaagagacttacagccaaaagacttatagacagtttaaatgttctaggccagacaggaatggacgtggacaggcatttattactccttaacaattttgaagtaatgtaaaagccaacaaacagaaagtaaaaggcgaggttacaaaattgccttatctatctttaacttctatgcattgagctactgtagtcttggttttagttacagatttttagcaattggctatataagcaagcctaaattttaaaaagaagagaaaatgaagcatacatttaaaagttcttaaactttttttttgaaacagggtttcactttgtcactcaggctggagtgcagtgatgtgatcatagctttctgcagccttgacttccgggctcaagtgatcctcccacctccgcctccttagtagctaggaccacaggcatgcaccagcacacccagcaaattaaaaaaaaattttttttaaagatgagatctcactatgttgcccaggctggtctgaaattcctgtcctcaagcaatcctcctgccttagcctcccaaagtgctgagattacaggcatgagctaccatgcctggcctaaaacatttttaatggaagtataatttgcaaacagaaaacatgcccaaatattaagtgaatgcactgatgaacattcacaacttaacaagatagccagcacttaaatcacaaaatagaacaccgctaggacctctttgtaataccctccaagtcactacttctgcccaaaggtaatcgctattttgcaacattttttattactttatataaatgagatcgtacactgcgtaatcttattactgtctggatttttatattaaatattgcttgtgagattcatccatgttgtcatgtcagcaatactttattctcattgccatatactattccatttttatcagtataccatgatatatttacccattctgctatttgtacatactggaattgttcccaggtttttgtaatacaagcaaagctgctatgaacatgcttggatttactttctttggtgaatatgtattactgttatgtacatgtctagaggtaaaattgatgatttatgggatatgcatatgtttaattttagcagatattgaaaaacagatttttaaagcggctgtagcaatttacattaccaccagcaatgtgtgagttccatttgctctccgtccttgacagcacatgttgtcacttaggtgggtatgcagggggatccttttttggcatgtttacttatttttttacacagtgcaaactggtgtggtgtaccgttttatggcttttgcctaatgccatcactaaagttaccaaacaattccatcacctcagaaattgctttgtaccgcctcttggcattcatccccttctccattctcaaccctggcagccactgatctaatttccattcccatagttttccagattatcaaagaaacagaatgatatggttgtaaccttttggatgtagcttctttcaggtagcaaaatgcttttgagatttaactatgttgttgtgttttcagtagttcattcctttgtgtgtgtgtgtgatagtctgactctcttgcccaggctggagtgcagtggtgtgatctcagcccactgcaacccctgcctcccacattcaagggattctcatgcctcaacctcccaagtagctggaactacaggcgtgcaccattgcgcctggctaatttttatatttttagtagagacaaggtttcgccatgttgaccaggctggtctcgaactcctggcctcaagtgatgcacctgcctctgcctcccaaagtgctgggatgacaggcgtgagccactgcacccagtccagaagttcattgctttttattgctgggtcatattccattgtatagatgtatcacattttgtttatgagtcctatagttgagggatacttggtttgtttccattttttctctattatggatacattgttataaacatttgtgtacagggtttgtgtgaacatagtttttatttcttttgagtaaataggagtgggattgctgggttacttggtaaattgctgggttatagttctttttgagaacttgtcaaacttttgctgagtggctataccattttgcattcccactaggagggcttgagagttccagttgttccacattcttgccagcacctggtactgctagtttttctgtgtgtgtttttgttttgttttgccactctaaggtgtatagtggtatctctttctggttataatttgcatttctctaatgattattaatgttgaacatcttttaacatgcttatttgccatccatctaacttctgtggtaaattttctgtttatattctcgtccattcaaaatattgggttgcttgttttcttatggttaattttaaaagctttatttggaaataattatagatttaaaggaagttgcaaagaattgtattcccttcactcacccttccccaatgttaacatcttgcctaactatggtacaatattagtatcagaaaattgacattggtacaatccacagaggttattcagattttaccagttatacatatacttgtgtgtgtgtgtttctatgcaattttatcacatgtatagttttgtgtagcttccacgacaatcaacatacagaactgtgccatcaccgcaacattcctctcatattacctctccacagcctcacccacttcctactctacatcccttacccttatcaaccactatttggtttaccatctgtataatgttgttattccaaggatgttatatacatggaagcatactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgctgtggtgcattctcggctcactgcaacctccaactccctggttcaagcgattctcctgcctcagcctcctgagtagctgggattacaggcatgcgccaccatgcccagctaatttttgtatttttagtagtgacagggtttcaccatgttcgccaggatggtcttgaattcctgacctcataatctgcctgccttggcctcctaaagtgctgggattacaggcgtgagccactgtgcctggccaatccatttttagtgtttaaagaaactgcaaaccaccatggcacatgtatacctatgtaactaacctgcacattctgcacatgtaccccagaatttaaagtataataaataataatactaattttttttttaaaaaaagaaactgccaaactattttccagagtgattgtgcagttttacattttgaccagcgatgtcagtgatccatttgctccacatcttcattagcatttggtgttgtcacagtgttttattttagccactttgataggtttctagcaatatctcattgtggttttaatttgcattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcgtggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattctcttaagagtgctctttacaaatatctttcttttattaatttccaatatcgcctgataacgttctttttttttttttttttttagacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttatagtgagccaagatcgaaccactgcactccagcctgggcaacagagtgagactgtgtctcaaaaaaaaaaaaaaaaaaaagcacaaaggactgttcagtacttttacattagctaagaactaatttacgctaacttcttttttatatgcaaaagatagtcataggatcttaataagttgtgtaatcatgttatttgagattgtatactatatgtagctcatgtcacattagttattttcacctaaggataccttaacattaggcctacagaaaattaatataatacctttgttctctgcaaaaggctacaacaagtgatctctagaggtgttttctgactctcaaatctctaactcttggattctgcctcatccagaaaggtttgggttaccaaagcaaagtaccataaactggatgacttgaaaacaacagaaatttatttttcatagttctggaggctggaagtcttagatctgggtgctaatatgagttctggtgaggaccctctttggggttgcagatggccatcttcttgctgtgtgttctcacacagaagaaagagagtgagctagctctctggcctgttcttataagggtacttatctcatttaggatggtcccaccctcatgatctaatcaccttccaaaggacccatttcctaataccatcaccttaggggtcaggatttcaacatataaattttgcggggacacattcaatccataacagattctttcctgttattattttagaatgacatggactctttcccagtccatttgggttaggattcttattcagcctggaggcagagccgtaccctgtatggcctatcacattccttttagcctgggtctctggttacttgtagaacccttatttataattattgtctaatgctgggattctccagagtgctgcttggagaaatttagcctcttagagacagttgcaataaaagaattctatcaaaaagaattcactgaattgtgatcacaaacaaaataactttgtggggataaaatgtactccaacaagggaggcttatgtttgtttttcagcctctcctcccagtgctgcacttctaatctctctgcagaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcgggagaactgtaattgatgttcattttggtatatttccctccagtattttttccatatggttttatttttaaaaattttaccccatatatatatacatatatatatacatactaactactcacaaaattaaaaattaaaaaaattaaaaatgtataaaatgaaagaaaaaaattagcctcattttgtatttactattttataatctgcctttttgcttaatcttctttgtcattatatgttcttctacctcatgatttttaatagctgcctagtattccattgtatagccatagttatttcatactttataattgctattgctagacatttagttggtttcctttttttgcttttataataatgtgtgttcctatacataaatcttgtaaatgtctgattttaaagataaatttctagcagcaaaacttcttagttaagaacatatacattaaaatacactcttattatatttttctttaccaaagtaatatatgtttattatagaacatgtacaaaatcacagatatacaaaaaaaacagcatataagttacttgtattcttcccactcagagacagccactattaacattttattgtaaccatccagccttcttttctctgtattctacatgctctttcataagctttttttattgaatgtattcagaatacctaagttcattgttcttttttaccttcactggttacatggcatttcactgaatgaacaaaccagaatttgtttgatgaatcttctaatgctggacatttcagttactttctgtttttctgtactataaacaatgcagaggtaagtagtgtgtgactacacctttccaagtccttgattgttccctgtgaagaaattcctagacgtgcaactgttgtttcacctgtatgttaatttttaaggcttttcatgggtattactaaatgttcctataacaatttttatcttagaggcagaatattggtatatcctttttttcccaaattcttgatattactattttgccaatttgactacaaagaattgattatcatattttaaaattaacatttatttaattacaagtaaaactgaactatttttttcttttttgcccaattttatgttttggtataggtttttccttgtttattaatagatttaaaaaataaatttgaaatattaatttcttgtcatttgttcaggttttctccttcaactgattgttgtgatgagttatatgtctagacttcctgatagtaaattgcactcctgaaataatccctccttgctcataatgtcttgccagatttggcttgctggcatttcatttaggatttttgcatctatattcctaagtgacattagtcttcagttttctttctctgtgtatttgtgtgggtgttcgtcaggttttgtgatcaggataactttaattttataaaatgaatgggcttattccttcttttattttataatgagaaccgcttttagagcatggaaattacctgttctttgtaaattaaaaagaacttgctcataaagctgtctgggcactgtaacaatcatcagaggaaaatgtgtaacaccctatttttccccacgttttctacttctttgtgattccagttagctaattttcctagaaaattgtcctttttattgagattttcaaactcgttaccatctttacagttttattgagatatgcatacaagtcacccatttaaagtgatttttagtgtattcagagctctagaccatcaccacaaccaccacaatagattttataacattttgaaaaccccagaaagaaaccccatgcccattagcagtcaccctctatttccccttaattcccccccttgtcctagataaccactaatctactttctatctccatagaattcccctattctggacctttcatataaatggaatcacacactgtatggtcttctatggcagccttctttcacttagtgtaacgttttcagagttcatccatactgtagcatgtagcagcactttattctctctcttttttaagttttcgtttttgattaacagactactttttagagcagttttaagtttacagaaaattgagcagatagtacagagaattcccttatactgccctcctctccactcctgaccataattttgcccacaaacatcttgcattggtgtggtatatttgtcataatcaatgaattgatattgacacattatgattaactgaagtccgtacatttgggttcattctttgtgttgtacagttctatgggttttgacaaatgtctaatgtcatatatctaccattacagtatcatacagagtagttttgatgaaaaggtaaaacacaggggacttttagggcagtctttccctcctccctgtgaacacctaccaaccactgatcttttgatttgcctttcccagaatgttatataattggaataatatagcatgtaatcttttcagaggcttctatcactaagtaatatgcatgtaagcttcttccctgtctttctttggcttaatggctcatttctttttatggctaagtaatattctattgtatggatttaccacagtttatcccttcaccttttaaagaacgtcttggttacttccaatttggggcaattatggataaagctgcttcagtcatttgtgtgcaggtttttgtgggcacataagttttcacctgatttaggtaaataccagtgagcatagactatgtttatctttgtaagaaactgccaaactggcttccaaagtggctttgtaattttgcattctgaccagcaatgtataagagttcctgttgctttacatcctcgccatcatttggtgttgtaagttgtttggatttttgtcattctgataggtttgtactggtagttcatggttttaatttgcaattctctgataacatacgatgttgagcatctttttacatgcttatttgccatccatacattttctttgatgcgatgtctgtttagatatttttcccatttttaaattgattgttttctttttttgtatagtggatacaaatcctttatcagatatgtgttttgaaaatatttctcacactctatggattctgttttcattctcttaacagtacctttcacagagcataaggtttttggtttaattttactaaagtccagtttctttttatggctaatattccatcatatggatataccacattttgtttattcatttatcacttgatggacacttgagttacttccttttggctattgtaaataatgttgttatgaacatttggtagaagttttttttttgaaacggagttttgcccttgttgcccaggctggagtgcaatctccgtgattctcctgcctcagcctcccaagtagctgggatcacaggcatgtgtcaccatgcctggctaattttgtatttttagtagagacggggtttctccatgttggtcaggctggtctcgaacacccgaccaaggcgatccacctgcctcagcctcccaaagtgctgggattacaggcgtgagtcaccgtgcccggcctggtagaagtttttatatgaatatatgttgtcatttctcttgagtagatacccagcagtagaactgctgagtcatatgataactcaatgtttaactcttaaaaaaaaaataaaaaaaaaactgaacaacttttccaaagcggctgcaccattttatattgccatgcctcctacattgctagtggcattttacgttgtcactagcagtgtagacgggttccgttttctccatatcctcaccaatgcttgttatcagtattttttgttatagccattgtagtgggtgtgaactggtgtctcattatgattgacttgtatttccataatgactcatgacattgaacatattttcatgtgcttattgaccatttgtatatcttctttgcctcttcacttttgatattcttttccatgggaatttcatggatttcactaaaatctttgtgcagatgatttccaatatttacttccaactttgacctttctcctgagattgtcgcagtttcccatctgtttcttagccattaatgccctaattgcagaatcagtgtgtcacaactgaaattcatcatctttcctcccaatcaatttattcttcctctgtgttccttatttctgttaatcatagattaactaatcttctaatgattagactattcttctaatcatccagactttcaatttggcatcatatttacatgtaagagaaatgagataggaaggaatcagtttgttgccaagttccacattactttcataatattttgcatatgttttctctttactttgtattctctccttcctgatctctatcctcttctgacttttttgatcccttactcttctggttctcctgtctttgatcgttttatttcaggttattcttatctgccccttaaattacctatctgcaagatctcagctcactgcaacctccacctcctgggctcaagtgatcctcccacctcagcctcctgagtagccagtaccataggtgcacaccaccatgcccagctaaagggtttcaccatgtcgcctaggcttgtcttgagcttctgaactcctgagctcaaatgatccacctgccttggccttccagagtgctaggattataggcatgagccactgtgtccaaccgtccacaatcttttacaaatcaatgtttaccttccttcttggctatttgtatgtagtcttaagatatgaactatcacttacacacataactcccaaataaatatttctagccttggaatattctgagaacttcagacacatatatcaaactatctgtaggacagatgtccaactggatagatggacatttgtagaatagatgtgcaattggatacatgtccaaacttaactctccccaccttagctgcccccaaacttgttcctcttgtcatatttccagtcaatggcatgaccatccatctgggttctcaggacatacatctgaccatcattcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatcaaaataagaacaagtacaacaatatttactgtctctctggtggctgcttacttttctaaaggatatagtttaagctctttagcctgtcatattgtactgctccctacctacttcttcagctttgtctcttgtcactccagaaatattcttctgtcttttaatgtgttccctctgctcagatgcttcttcctgccttctttacttagtgaaccaccatctgagatttcttggaggtagacacgatcacatggctggaatccaaaagggatggtcgataagaaccggcttcagtgaatgtggatttacatactttctgggagctctgtatgtaaaggaaatgcttccagcccttcctcgcttggctcttggcatataacttctgatggctctcctgctttagtagtcacttttggagcaatgagagatcagattcctttagtggcctgggaatgatgtcacatggtgttattgatagaagcctgcagagcttgggattctgagaagcaatcttcagactagaacttaccccaagagaatgagcaactctatggtagagggcgagagcctcgaacaggcccaataacctctagtccaaggactttgggaagttttatggtcccttctaggcctacaggatacaagcactcagggatagcagtgtttttgggtaaagaacagtgcggggctctgggctcaaattcctgggggcaaacaaatcaatttggctcccctcagctctgtgggactaaactttaaaactgcccctgggagtgacctccccaggataatctcagggtactcagtactcacctgagtagacaagccccaggaagacctggatgagtctttggaagtcatctttttagctcagttttgcctgctccaccaggatccacaccctttactatggaaatctgagtacgagttagggcagatgtcagtgaggagaaggattggagctcagtgacctttcctcagtagtgcttacttgtgaagcctgtgtccttaggaaattagcgctgcctctgccaaagtggctttttactgtgttatcctttcccagagtgcacttccagtctcgtttaggccagtgtagttcctgttgagttaagtggctgtgaaaaaaatgttttctgaaaggaattcggaggaaagataccttattccagtgaacagtttgcgaactcaggagacacagccttttgtataaaaggaagttatgtttcagagaacaaagagagtgtttgggttttatagcaaaagtttctgcctgagttcctaatcaggtttatttatgcaaatgaaatattgaaatgggcttagttctagttggttgatgcagctaagttctgattggtaaatacagctaagccctaattggttggtataggtgagctctgaaagtcccaaagttaaagagaggtgggagtttttgggaaactcagagtgacctttagtcagcaaatggctgcctggctgtattttaaatttaggcccagttagccacttgggatccatcttgaaggattgactcttttaggttcatatttgttcacatgtggctttcttcctctgataccttggtgagcctaatggagactaaaagcttagttaactttggctttagggaatgaaattatttctggctgagacactaagtagaagctaaaattgcagaaatatctttataatactatgtgagagtttacaaaaactctcacatacattattcaatttattaaatcttcacacaagctagtgcctgtcccttagtaatcacatgtttagtgtatgaatgaacatggaggtttttgttttattttgctttgtagagagacagggtgtctctcactcttgcccaggcaggagtgcagtggtgcgatcatagctcactgcagccttgaacttctgggctcaagtgatcctaatgcttcagcctcccaagtagctaggactaaaggcatgcaccatcactaatgcctggctgtttttttttttgtagagacagggtttcccgggcatgtcttgaactcctggcctcaagtggtcatcctgcctcagcctctcaaagtgctgggatcataggcatgagccaccacacctggccaaacgtggggatttattgtgcctattttacagtttggcgaactgaggtctaagcagctgaattgagtttcctaaaattcaactctacagttagccaagtatggagcctacacttgaaattagatccatttcaggtgaacatttactaagcatctactaagtgacaggtacttatcagtgatgaataaacatgttccttggttttgagagcttataggcttgtcagaatatgagcaaataatttcaacacaatatgctaagtgtcatgatagagaactttgtgtgatgccgtggagtcatacggaggggcacctaatccagtctgataatgttgtgaaagactacctgaagaagtgacacctcagttaagttttgaaggttcattggagattggccaagggtaaagatattctaggctgagagatcagccccagtcagggcacagaggtgcaaaccagtatggtatgtttttaggattgctggagtattccttgccaaggggaaaatggcagaaatgatgacttagagaggtaggtgagattcagatcattgagtacgtagactttgctttgtacaccattagttactacacattgctgaattattgaaatcatctggggaacaggcattttcttagttagctagatttgagagtcacatgtggaggcaatgagtgacatagactgccctgttgcatcactctggtgacagtctacatggaggcaggtagatttgaaagggatgctactagacgcctagagaccattttgaaggtcactgaattcatctaagagatatggtggactgtataaggcagtagcagtgaggacagagaggaagaggcagatgcaaaatggtgaaactcttacgatgttgtggggaggattggtgagggagagaaaagtgtctaaggtaattctccaggtttctggcatggctgtctgagtagatggtggtatttttgaccaagttcaggaatgaacagtggagatagaatgtacaaaaaaattggataaattcagcttggaacctgctgaatttgaggtactgtgggacttccagaggggagagcagctattttgttctggaactcaggatgtgtctaggctggaaatacaggtcaaggcctctatgtctgggcagtttaaacccaagtgaatagtaagacatctctcagagagaatgtgtggagagtgcatcttcaataattctaccccctttcgacttcaaaggctgttcccatggggaagcagaagcagcgtatttctctctctctctttttaatgtttgaggcaacaagggatactgaaaatgctataaaaggtggagttagaaaacctgagttcaagccctgcttctgacacttcaccactctgcaaccgtcagtagttcctgagcctctcttagcctccaggtcttcatctgtgaaacaagggtagtaggaataactgcttcacaggattattaagatagtccaatgagaatgtgtatgtggaaagtgctgtgtaaagaaccatagaaacatcatttttgttgttgttgttgtttgtttgtttgttttgtttttttcccctagaaacttggaccaatatgtaggaattacggggagacagatttggtccaatataaggaaagactaatactttgactgttggatgatgggaagagctttgggagatgggaagctctgaggctctggatatccttaagcaaaagccaggtttctgggcatatgctgagcgttttgttgtcaggggttgggtcatcctgcatgacctctgagttacctttcaggctcagatagaatttgagttactagaacacttatctacctattttctgaaattttctacactaagtagattttttaaattgtaaaagcaatacaagcgcatggtctttccctttgactctcttaaagtactgggcattttggatcctaagtggagacttggtttatataccctgaataatggggcaaactgcctcatgtcttactgcatgaggcatttatggacagacattttcttaatgttctttaatgagatctctttaaaataataatttttttcttattttcaagcagaaatgatattataaaaagctaacaaaatattgccaagtagaggtcttgatcgagtatactccaatgagtaggtaaaggtcatttgaaatcagcacactaattatttatatgcaaatgaatttgttagagagcttggaaagagttgttctctgaactgggttaaacatcccctaagagctcatgtttatactcttaatttactcagaaacctgttgttgctctttctttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagctctttctttaattgatagaggaaaggtgaaatatgccagccatgactgagttatcacaaatttagaaatggcatgaattgaatttatactttcctgtgtttattttattgccaatcactgatgtgacacacatttgctaaacaagttctaattttctgggtaactttccctacagaaagcttatttcgctaaatgaaagatctctactcatgccatttaatgaggaattatctttatgattgttgaggtgtcttcctggctctttgaaaaaaatcacaaaaacaatagccccaaataatagtgattttatacctagaaaatattctacaaggaataagttgctgtaaaccatatagaggtgaacaattttgaaaagtcaagaatttaggaaagtacattcagtcttaattatggtagaataaaatttcatcttcctgatgcttccataggcccttcaagatgtttgcaaagcccttggtcagcttttgattattttttcattgtactgtatctatgaaaaaggttgccattgggaaagcataagtaggttgtgttttgcaattccttcttgtggaaggaaattgatagaaccttctagttgattttttgaaaaagtaaagatgtttaaatactcttgccttccctaccttactccacacttctggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgcttcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagtcttcagccaaattacgagtacagcaaattaacacaatttgttaatttcctttttaattacactacgaacaggagtatttctgtattttggcttttttttgacatagagacttcatcttaaaagcagaaagactttaatatagctaaatctatatctataacaaataaagcttgtttcattttccttacccagctggctaagatttatacattaattattcaaccgatgcatcttaaacatcctagttaaaatacacactgttggccagaaattgttaaacctccagcatacttttgtttgcctgtaaggaataaatacttagaactgtaaatgggtaaacttaatctttccatgtggtgaggtcaacagaactcatggtgaacatacaaagaataggggactaattattattgagattcaggtaagtgatttcttaggcattttagctgtcatgctgtggaataattgtaaactcaccaggaaggaattgcaaaacacaacctacttatcctttccccagtggctatatagaatttttttctgtcctgcagtttgtgccaactctaatcattaaaaggaatgttattttaagtattgcttcctcaataacagtgtttgacagaaactctacagaatggtggctttgcccagagtgtggcttcagtatgctagtgtgatttaggcaatcagagctattggtaatggaatgcagatctctgtagcaattttatttaaagttttgcctagttaatattatatccaactaatgtaaccatctgtatccggccccatcagtgacaatataaaactgttaaacaccatttcataggcattaagtgctttggctttggtataattttatgatcatgtcttattcttattgtagtacttcattactatcttttttttttttttttttttttgagacggagtctcattctgtagcccaggctggagtgctgtggtgcaatctcagctcactgcaacctccacctcccaggtcctggttcgagcaattctcctgcctcagcctcccgagtagctgggattacagacacacaccaccatgcccagctaatttttgtatttttagtagagacggggtttcaccatgttgaccagactggtcttgaactcctgaccttgtgatccgcccgcctcggccttccaaagtgctgggattacaggtgtgagccgccgcgcccagccactatcatttaaatgtcagtaacagcagcagcaagtattctaggcatagcacagagaccaaggtaatgggtctcccagccttgtgactaaattcttcctgcctctaggtcttcacgtagtctgttgccttgtccaggaatgcccttcaaaccttggtttaaaggccttttcagataagtctctctttttccccctagtattcttgatcactgtacctatttgtcttctccatagtatttatcacaatttaaaattatacttgtattttttaaaaaaacttgtctcccccactagaatgtaagctatacaaggacagagaccatgcctatattttatttattattttacaaaatttttattttttaattgtaaattaacaaattgtagttacatatatttatggggtacaaagtgatgttatgatttatgaagacaatgtggaatgattaaatcaagctaattaacatatccaccacctcaaatattaacccatatatccttttgcgtagcaaagtaagtagggactgtaaatattttttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggatttaaataggtgattctatgttgtaaaagttttaaaaatgactgtgcctcaggaatacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactgctgtgattctcatttttgagttccacagatttgggacggagattttatattggcaaatatttctgaagagacaaataattgcctctggaaagaggcttcttttctcttccaaaaattcatatttgctggtttaaattgatgtgactattttttggctagaactctgcagtatttcactgagcagtaattattcctttggtgttgcaggagttttctgagagaagggaactaaatctaagagagcgaatccatctggtacatatgttgaagctctctatgaggccactgacactgaaatgttaatgctaggtttctataaactggtatcatttagatattgatacaatatgagctagtactctgggtcactgaaccaaaggctgaattccatttccttatatggcactggattcctgcaccagtggattgatgactcttggcagagtaccatggtaagatagaccctgcattccagtcctgtcacccgattgtcagactctggctgtcccagccccaatcaggagtagacactaaaggccagcagctggcaaacttagtgtctcttagtacctcaagcattggtaggtaactaagcttgacgggatagtagaagtacctacacatagtaggtaattaattctagattagtctgataccttaagtgttaagtgcccctgagaagaacccctggggcccatggagactcactaatctgcagcttttctttttacattatggtgtgggtgaaaccaggatgtgttccaggactgaactggtggctgtcctgcttgggtggggatctggcatccagcctagccattgctaggtttttccctggggtgttggactctgtttctccaccaaactgccaactaacattcaattcaaataaaatgtcttagaaatatggtgctgccgccgtatgtaaggtgcagggtggcagcaccatgtttccaagattagtattgccactgtgcaaggtctttcctagccagattgttcagcttgcatttatcatgattttttcatctttgtaacttggatagccagtcagccctcttagggacaactctggggctctccaagttctgattcttcttgatctgtgctcattattctttttctgctcttcttacattgaagtcttggaaatcccaaccattgctataaaagttctgttgcaaagaatggaaaatagcctattttatcccatagcccagttacacatacatagggagctatggacatctcactgttcactttgagttgaacttgaaattcctgcctctcctcttcgggaagtattaaccaaagaagccacaaggggattcactagtctcctatgaaataaaatgctatcagataccaaacagctaactgtccagatttttcagcaaaaattggctgctttagttttttgaaattttttcctctctcctctgtagttcagtatgagagactcttcagggcaaattgtcagtgggaggaattcggagatgccatatgtcatcagtacatggctgaggagaagccaaaaaagtattaccgccgttttcccaaaaagctattagggaaggttattgattgttttccacacaccttccaccttcatcacagggtattgtgataactaaaaaggtactttcatgtagctcttaaaaacagttttctccttttttgttttcttaatatccactgtgcccaggtcacttcacagagctccaaagtgatgctcctttctttctccataggatttgtccttgcccttctggcaaatggacttgaattgctactgcttctgtcagctggtggctatgtttacttcaaggtctttgagtaggccagacaagtccaattacataaatcattattgactgctgtcaaccccctgtccctccctcttacacttgtttttctacccctacctccctctgctttctatataggattggagatgccatttttttccttcagactttcaggctttttaataaaaatggtgcttaaaggtacatgtcagcagacttttgggtgacctttaaagtagagtggtatttggtctgtacaaaataacccattctctatcatttatagattgtccacattatacctaattttaaaattcttgatgacatctattaggcttaagcccttaaactagttcatgagggtacaagggtattgtagcattaatgccctgtaggtaaagtgaatgttggtatttgatcttttttttttaacattcttaaataattattattattatttattattattatactttaagttttagggcacatgtgcacaatgtgcaggttagttacatatgtatacatgtgccatgctggtgtggtatttgatcttttagttggtacctggaccatccttcagtggggctttcctgcttttcccctttccccttttgtgttgttggattaaggtatatttcatttattcttactctgtgttcatttcaacataagcatcacagacccattaattaagaacagctggctatgttctcctgccacatttctaatttctcaatgcccagttgacaaacagaatcctatctagagcaaagtcatttgttccaggctcagaacacatggagggcccagaaccatacgttgcacttttgtttcagttagaagtcttccatgggcttttcttccagtcacactaaagtagtatttgcagaaatgaagtttctttgggtcttgttttgtttttgtttttgaagatggaatctaagatcatctcagtttagttctttgcctttttgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggaaacctcacgtctgattcggatataaagggctgatttggcttatttatatgatttcaattcacaggcagccataatcaagtgcttactaggcttgtaagagcagccagaggtcagaccatttaggaacacactggggatgataggagctattggttacagtgcaccctcatccaggcacatgtatcattaccctctggcccatagccacaagtatatccttgtccccaacccaccatcttccaaatgcacactatgattataacagggagcatggttggattgatgtggcagtccacatggaaacacagattttgccagaggtcctctttcctgatgttgtttcaccttcactgtgggctgtcattcatgttgcttcatatctatgttgctttgctgtaagatgcatgggtctttcatagactgctcttccttttttgctattggggtgtgaaaggtattgctcctttaaaaaagtacagcagggctgggcgctgtggctcacacctgtaatcccagcactttgggaggccaaggtgggcggattacctgaggtcaggagttcaagaccagcctagccaacatggtgaaaccccgtctctactaaaaatacaaaaaattagctgggcatggtggcaggcacctgtaatctcagctactcgggaggctgaggcaatagaatcgcttgaacccgggaagcggaggttgcagtgagccaagatcatgccattgcactccagcctggacaacaagagcgaaactctgtcttaaaaaaaaaaaaatagtacagcataaatccttccaaacatgagtagagaaactctctaaggaagaaaaatctctggatggaggtgccagggtctacttgggcaggtgttctattgtgacatagctgtctttttttctgtttagcccttggaaaaatgtgtgttttcttggattcaatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggaacctgtcttaagggtcaagagatagttgagttcctctattaaaaacaatgaaggctagaccctgtcttctccattaggaatcctgagcattggtgaggaaattcatactaaaaccttgctgctaccaatatcttattccttatactggatctccagtaaaatgtgcatatatatatgcatatatatatgggtttaaaattatttttatcaatgcaataatatgaataatttttgtaatcaggcttataataacatcaacaaaaccaatcaggccggtactgcttcctcccaatcctgctcctcttgcttttggtacttaccttcatattttatgtaatatgcttatgctgccattacttgattcattattttagatattgtgtgtttacttcttgtgatgatagatgagaggctggctgtctcatagtccctatcagtcgagtatggctggtctgtgctgcataacaagacattcctagttaccaggggctttacagaacagaagtttatttcttgctcatgctacacattcaacttaagtgggcagggggcctctggctcatgttggtcactgaaggatggacatgggatgatggaggctccaactcaacacctgatcacatgatctatgaaatgggcaaataaagagttaattgcctgctgcctctcaaaacttcttcccaggtatgatataaattaattttactcacattttattggtcaaagcaagctacatgactatacttaatctgaaaagaggcctggaagtacaaccctaccatgtgcctgggaaaagatgctctggaatatttgtgaacagccctaatgatgaccatacagcctctccattttctttcctccattactccagtataagtaaatcatgtattttttcaaaattggtattcagtgtttgttattatagctttgcatttatgtccagtgccaagccaagcaatgcattatgctttcacttccttttttgaataatattttattttccccagagtcaataattgcctaatttcttatttgcttagttttctttttactcatttcttattttctgcacaacattcatcagatttatcaagtagtcctcagtattattttttgaacactgaaatatatcagataacctaccaattttattttttcttggagtcttccagcctcccgcttcagccttggctctctgggccttctgtacaggaatcatcctccctttgccagtttcctgtattaggaccctagtttttgggtcttttgtctcctttttaaaaattatttgcttacttgttttgctggagcacgtgctttaatagcttcctaaataaaggtttatgacaaattatattagtcagctttttagtaggctatgccgtggtgcaaatgattccaaaatcccaatggcttatacaagatttctttcttactggtatcctatgtctttcatgggttagcagtagttctagccaggtctttttcactctggcacctaggttaagggagcagcccctctctaggagaagcagttctcatggcagaggaaaaatagcactgattgaatcagtgttggctgtcaaagctgctgctctgaagtggtacacatcacttctgttcacatgtcattggaaaatcaagtcttatggccaagcttgatgtcaataagcctggaaaataaaaataatccttccacaggtaaaattatatttttgccaaaggaaataaatagctgtgttgcgtataaaattatgaattggtttttcgcagaattttgaaggcattgctccattgtctcctcgttttcagtgttgttatttaaaaggctgatgccaatctagttctggtataagagtcttccgtataagcattgtttttttcctttgctctgaaaccttttaggttctttttttttttagcccttataattcagacatgttttgacagtgtgacttggtatagatctttatgcattcattttactgatccttccttaggagctttaaatgtggaaatttatgtccttatttttcttacattatgactttgataattttctccccttcgttttttctttctgaaatttcaattatttggatattagacctcccatattgttcctctgcttttcttgtcttttcctctcttggtctttatgttcttctttttgggagattttcttattttaatccttttacttttttgcagtttgattatcatattttcagtgtccttaaattcctttgttttctgtgtcttcctttttgtagtatcctgcttatgcttatggatataaattttctcttatctctgaggatattaattatagttttaagttttcttctgttattgtatcatctctgttttctctgtttgtttgttttgacttctctcatattggaagagttcctcaaatgttttgtgatccttggctgtctattcatattgaagagtggaactctcttgtttcctgggggcaaagggagaggataaaatagttatctaggtagctgcatgctgaaaagtatatatgggagcctgctgctccctatacagagttttaattcctgttttcctgtgtcttatcccaatttctgtggtacttggtatttctaaacccttaagccttcccaggattcaatggggactaattgtttcacttttcattggcatgtctttctgcaagcacttaggttctaacttgcttttcctttactctctgaaataaatattcgttcttcccatcatttcctgtcttcgaaacatttatggataattcttgtccactaatgtctccttccctgttttcttagtctgcgtggacttaacacctctttctctctgtctttctcttctctctctctctctctctctcacacacacacacacacacacacacacactttttatttgcattgttttaattccattaatgagacttcgggagggagagagataatcatgtgttatcagtctgccatgtttaaccagaagtcaagctgtggtagaattttttaaatgtagttttctttacctcatgctaaactgagcatggccttaaaatctacccctgttctttgaaataaaactagccttatacttggatagatgacatgctttcaccaccaaattttaaagacaaaacttgaatgttgatggaaattaaaatgtgtttagcactttctgacactatgcatggtaaataaataaatgaatgaatcagtgaaaagaaaggaaagtcaccataatggatactcttgagtttcccactccagctgcactctctacccttccttaccctgctctgggcccctggagactgacttctatgggctgcatcaaccaggctcccttgtcctctggcttccagttaggtttgacaatgcaacgtatcagtgggggagggagaaaggatcagagggttgagaggaaagccagatctcagtatttacttctccagcttcttctctgccaggtcacatttggcagtggctgtgttccactatttcatgccatagcttgtgttgggttgtccctctctgacagcctcagcttttaccaggttctggtaaccattactctccttctcacttcaggtcgagagatggtagtggtttcttcctgctactgatccaggaccaatgcaccttaccttataggttcccttaaccctgcccctaccttcagttacaccttttgaatgtgctgtgtttcctgccaagaccctgcttgatacaaatgttatggtagcactgtctcattatcatccatgtattcttgaacaacatactccacatcatgggcctcagtttccatatctgaaaagtactaaggtggcgataggtggtctggtctgtcatgtaagaactccttcctgttctgacatctctggttttatatgatgcagcagtggtcagtagccagctctagctctaagttctcttttatagactttgtggaccattgtggataattctgagtggtggatgatcacaaaacaatttcttcctgtctttgggaggcagtttgctggagcaaaaggattatagactttggagtcagaccagggttcaaatttgagtgtactactttcttactatatgacctttaatccattactaaacctctctaagtctcacattcttcatcttaagattagggtatatgatggacactgctagttatctatcctagccgttttcttttcccttgctaaaagaatactattttccattacatatgtagctgaacatttagttggatgttttgataaatgcagtttgcatagacataactagtatttactaccatctgattctctccttctgaaagcatgaaagactaatttccaagcttcctatagttaggtgggatcatatgattaggtctggccaatgagctgtgagggaaaattacctgtgacactttggggctgaagtagaaaaaagcaagtgtgcaatctctgtgtgctctcttacccctgctgaggcaatggggaacaatctccatggtggaacttccatcaatcaagggtccctaagtgactatatggaacatagacactcataaacttgcaggcaacatgtagcatgagtgagaagtaaaccattgttgtgttaggccattggggttttgtggttgatttgtcagctaatccacagctgaaaagcatccctacagttataggacattatctttcttgtagggttgtatggaacagactttctagatttgattcctagctctgttatctattaacttgtacgtccttggtcaagttacttaacctttctgtgccttggtttcctcatctgtagaatgagattaataataccttttcctcatgaggtcagtgtgggtactaaggaaattaatatacaggaagcacttaaaacaaggcctggcaggtagcaagtgctatgcagcattttctgtcagagatcatgtatttcagagtgtcaaatacagtgtctggctctcaccaacaacttaatgctttattacctttattgctgtcataagggttagaatgatccatgtaaagtcttcacatatggtggccacttaacacaatggcactattatttgatgactgatttttgtgcttaattctggatatatgcccctcattttttagttctcttaatcattgccctctaagatttccttcacaacatgggaggtagttaagtgtatggatttccaagagtagttctgaatacgaagttaagaagatgttgaaatggcagcaaagccttaatttaacagggaaggcattcatcaaaagtgttgttatccataagtttgaaaccaaggcgacccacagagaagctacacttgtgaaaatgagccttggataatgagtatttcattatatttgccatttagagcccttacacactgtctgtccatgctcttcattttgcagatgagaaaacttaagcctagagaagggaaatgaatagtctaggataacacagtcagttaacagcataagcagaactagagcccaagtacactgattcttgatctgtatctacattttgcatctgtaaagctatacaatatttccttctagtacttgaataagaaagtcattggcttttcatctcaaaactctcaaaagcttagcagaaactcagagatgtggtttcggaggaaccagaggaattcaggtgagcagtgtaaggtagaaaaagtcaggtttggtcttgtaacatttgtgccatttgaaaactgttgtcagacaactgcaaccctagactcaatgtgaaaattaaagtaactttgcttttatgtgctgtccttttcagagctcatcatccattttgttggtgccattttgctcatgtctttgaatacatcaaaagtggcttgattttctctttcctttgctgtctattcactggctgcaagaatgtcctgtccattccagattttggatgggctgtccagaatcaccacagacttcgcttcttagccagctagaggaaggcagaaatgaaagagccctgccagcgtgtttcctttctgtaagtttccttggacacgaacacaggagcagagtttctatggagcagctggtctccccattttggattttgctgaggcaggtagttgaactctttgaggaagtctgggttttctctgtcttgggaaattactgataacatcagagccagaaggaggtgagtaaaatggaaaagaaaattcataagagtcgtgccaagattgagatttccaaccccacccaattcttccccagctctcctttcagctgctacttgcttcccaggaagcaacaaacaataggctactgattgaatttaggtctgaacttcatacaattaaaggtgaggcaagtaaaacatagttacatttagaatcaaagtctccgtgtttccatcaggaggcacagtctgtatgtatactttagaaagtgggtctggttctgaagccaaacttgaaagcccattcattttggtaattattttcttttttaaagcaagaataatctttattccttggaaactaatttataaaattgttatcaataagatgaaaagattcatggtaattattttcttgttcatagtttcttgctggcttttttttggaactaatcacttccaggaaagtgcagaggtcttacagtgaagagaaggaaaagcatattaattgtagctggactgggtctagatcatgagagctggaatatcctaagatctgggacaaagggacagccattgggcagctgtactttatggtaggcaacatagcacaaagattcagttgtttcttttttaccccctccaggacaatttaaatgtctactctggttagtttctgagagtaggtaccatgttacttaaaaaattctactcattgtaaatgaagttgtatcaacacataacaactgccacttggaaatcatctttgtctttccctgatgtccctttttcgtatccttctctctagtactcattccttcagtcagtgaatttatgctgcaacttgactacatgccaggcacaacaccggcaccattgatataatgttgactaagacagtgttccacttgcttattgctgtgtgataaaccaccctcaaaacttagttgcttaatgtaaaaaccattttactatagctcacaattcagaaattcaggcagggctcatcttggtgattcttttgatcaacacggattacccagtgacactcagctggtaaatgcgctggtatggtaacctcctctctgtatccccctctccagtttcacacacatgtctgtctggtgctttggcaaggatggcaggaaggctaggctcagctggccctgtcaaccagagaacctacacacggcctcaacagcatggtgacctcagggtggttggacttcttatgtgtcagctcagggccccaagggctagtgttccagcgatccaagtggaaaatgtacaaccttttatgactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctcctgctcagcattacatatcatactagaacaacaaccaactctgctggcaaacacacatgcacagggcacagtgcgtagtcctgtctctacacacagctgctggtttcattcggattggttaaaatctaattgtttgaatgaattcaggggttgctaagtgattagtacttatttaggctagttcagtcagaactggcaattggcattgttgttccatctgctgaggctgttccccctcttcttcctcttgctaatgctgctcattcttttgaattcagtatgaggagccccttcttcctggaaaaaaactttttgaccaccctcatcccaatttaatttagatgcgttcctcttgactcccaagcaccacccaaaaatgtactgttaatccagcagacatatctgcaacgggaatgtcaactattgaccaggttcttgctgagagagctacagatactggggtgattcagactgatacagtcgctccctacaccagtaaatctcccagtctggtggtgaaggcagatatcaaacgaatcgttaaaaatgtattgaatgttcctaataatgcctgactcagagtcacatgggtagtgatagggactgtgccatcttttctgttgttgtcatggtgcctggcatataataccatatcagtaaatgttttttatgtgcatgaatgaattttggtggtatatttattgaacatgtggataaagttatgtcagtagaatgtcatttatctttttattagagcccttctaagattttaccaggctgggccatgatgccttccattaagaaacagtggattggggtggagggagggagagcattaggaaaaatagctgatggatgcggggcttaatacctaggtgatgtgttgataaatgcagcaaaccaccatagcacacttttacgtgtgtaacaaacctgtacatcctgcacatgtaccctggaacttaaaaattaaaataaaaaataaacattggagacagggcctacatctggatccagtcgatcctttttgctgccagccaggttatgccagcctcctctcatcccttggtcagtctgatatctggggggctgcaaagtggtacctcacatatcaagttttgaccttcttctctgttaacctttgactttagctatcatgaccctatcgatagatgaacctgtttcctgctgcccatcatatcctatcctttggaataatttgtggcagtacttgactagggcttttctgacctagacctgtcctgagcagacacatgttgtcctctgccatgttctggggaacctaactggcagctaccttgatccttcctggttcacttgccttccaatattggcttttccctaatatgatttccagatcccaaggttgttggttagttttttgttttgttttgtttttgtttttgttttttttttaggcaaggtctctgttacccaggctggagtacagtggtgccatcacagctcactgcagcctcatctcctgggttcaagcaatcctcccacctcagccacccaagtaattgggactagaggcatgtactaccatgcctggataactttcttattttttgttaacacagaatctctatgttgctcaggctgttctcgaactcctgggctcaagcgatcctcctgccttggccactcaaagtgctgggattacagatatgagccaccgtgcccagtaatcccaagtttttagaacaacaacaaaaaagtatagtccttggaactagacataattgattttgaaaggatttctgtatttgctagctttatcattctgagcctaattttctcatctgcaaaaatggggataaaaatcgtgacatcacagggttattttaagtgtagtacctaccatgtaattgctgagaaagtggtagttccctcccatatcccatctcaatgtattgacttttgtattcaaagaagacattattgattactttctctccagtaccttatttactttagggtacttttcctagatggggatagtggcttgcttccagggctggccttgaccacaccgttatcagagcttctggactccaatgacatgactacctgactccctcacttggagaatctgggtcccatggcttctggcacaatgacttcactatggctgcagttctaccttttccctccaaccgtggctcagtgccaggatagaaggaaaatgcgaaagagtttgacaatatttcagagaggagacttttagcagaagttatagctttgctgtcctgggcagtgttatgaaggagctttcccacacattcctctggatcctaccttcatctgccacctttactcctggttctttcttctaagaggatacagtagtatatttgggtggcttgtgacatgacagtatctcttattttgacctcccatagcatttaagcatttattgtctgtaaatgtttaattatgtttttctctctgtgaatttcatgtatgattaaagtatgctagtcataaatcattcaagataacactaagctcttcaatggcaagggttatgaatgaatagcccagggcctgaacacaacctgagaactgctattttttttttttttttttttttgagacagagtctcgctctgtcgcccaggctggagtgcagtggtgcaatctcagctcactgcaggctccacctcccgggttcacgctgttctcctgcctcagcctcccgagtagctgggactacaggcgcccaccaccacgcccggctaattgtttgtattttttttagtagagacggggtttcaccgtgttggcaaggatagtctcgatctcctgacctcgtgatccacccgccttggcctcccaaagtgctgggattacaggcatgagctaccgcgcccggaccgagaactgctattttagggcataggatgaaaagagaagtcaatgaagaaaactgaggagaagtgagagaagcaggaggaaaaacagcaaaatggaatgttaaagaaccctgatgaggaaagtttaggagagacagacaacaggatgtaagcttcaggatattttggagggttttgggcacatttcatttacagggtcataagggtagtgaagttggaatccagcactgttctcatcagtgtcaaggagggcaggaccagctttctctttatgtaaaccctcaaactttaatgggcactagaatccacaatcctgggccttacctacagagatccggtttcaatatgtaggaccaggaactctgtattttaacaaacatcacaggtgatcatgatgctggtggttccaaaaaaaacatgggtctccggttaacaaagtagtccaaggttgtattggtagtttgacagccctatcatgtcttgtgatgaggtaaagtccctaagtcacaaagtcagaatgatagaagggcccttagagggatgatctaccaacgcaactcagtgggggcactgtattagttcgttctcacactgctataaagacatacctgagattgcgtgatttataaagaaatgtttaattggctcacggttctgcgggctgtacaggcttctgcttctagggaggcctcatgaaacttaccatcatggcagaaagcgaaggggaagcaagcacatcttcacatggccagcaggagttgggtgaggtgctacacatgtttaaacaaacagtgctaggaggatggtgctaacccattacaaactacccccatgatccaatcacctcccaccaggcccttcctgtaacactggggattacacttcaacatgagatttgggtgggggcacagagccaaaccatatcaggcactattggaattttaggtgggaccatgcttccttgcaggggactgtttgtcctgtgcaatgcaagatgtgtagtacactttgttcccaccaactagattccagtagcacccctcagtcattctgatgaccaaaaaaccccaaccccatatatttcctcattcctcctaagggggcagtaccatccccactgagaaccactgccagtataatcccttcattttatgtgggagggaaatgggtctcagagcaggggaggaattcttcaaagtccctcagtgagcatttttgaagtaatatactctcaagtctgttattcttcatcctgtatttctgtaactaagtttgggaacctaaatgcaggcttgcctccccagttggatggtcagctttactagaaaagatagagacagtcatcttactaggtccctgttgtctctgacagcatcaagtatcatgctggctacacacaggcacctcccagatactcactgaactgaattgaaccacaaaactctgtggagctccttgaagatgaacaagattcagaaccctcctaggcagtaagtcttctttcaggagggaccgaattgtttgtttagattgcactttgaagagaaacattaactcattagcatattcttggtacatcaagaacattcatctggaccctgagccccgctagagtgtacatgccaggagggcagggaatgttgcctttcttcattgtttatcttcagctcctagactggtgcctggtacatagggagacactcagtaaatatttatgtatgaagaaatggctccaccttacaataaaagattgtttactttcttcagacaagtataaaataagcaaatgttttcaaggattattatgtccttggtgaaaagtaaaaagtaaatatgagttaaaagaatatgagtaccttgtatttgcaaagaagatttctaaaattcaaaggcttttctcatctactaaggaaaaggtagagaaatgtgccctttttgaacctacagtgaccgatgctgatggctagactaatgtcctcagagagaggctgctggtgctggtgctcagcacaccatcccttcctctgacctgttcagcactgtcaagagtgacatggagagaccaccgatggcctgtgaggagattcacagatgggggagctgggcagccaagtgaaggcatcggctcacacagtcattggctgtcagaaagtaacagtaaaccaaacccaagaggatgaaatgtaacagggaaatgtgggtttcaaaccccaatgaaccacgcaagagtgatctgctttaatagcaccaggtaggaggaagccttcagggtttcaattgatagaaagaccagcagtacctaacaggttgatgttgctgctccaaaagactgagtgacctcaaaccaccttactgaaggctagtgcctagagtacaagaagcagtggtccatacctgcacacacctgttctgtttacttcttacttgtgttcctgtcatacaaggcacctagacaaatgagagtccattcagaaagttaccaggatgtggatgactttgtaacctggttgtatagagaacagtggaaataactggagataatttactttaatattatgagaggagtctggggaccattatagcaacttgcaaagatttgaagggttgacatgtagggcaaagaacagtctggttctgtaatctcctgagaacagaatcaacactaacggattgaaatgcctgcaagtcagattattggctcaacacaagggaaaaccttctaatgactatgctatccacgacttcggtgggctagttcatttggtagtgagttccttgtcactggaagagttcaagtagtgaactgaccacttacctggcagggaagccatagagggggtttaaacgtctgatgagattgaactttatgacttttaacatttcgttcaagcctgaacacaagcctgttcaagtttgggttttgcattttcaaggtgataagtgaatctgattcaatatatgtgaatattatctatattgaaatattcaatatagattcaatattatatagatatctgtaatatattatatataataatatattatatataatataatatatttaatattatatataatatatgttatatataatataatatatttgatatatataataatatattatatatcatatataatatataatatatgatatataatatatcatatattatatataataatatataatatatcatatatataataatatattattatatcatatattatatataataatatattatatataatataatatatttaatatattatatataatatatttaatatattatatataatatatttaatatatataataatatgttatatataatatatttaatatatataataatatgttatatataatatatttaatatattatatataatatatgatatataatatataattatatattatatatcatatatgatataatatattatatataattatatattttatatcatatatgatataatataatatatcatatatgatatataatatatatcatatataataatatataatatatatcatatataataatatataatataatatatgatataataatataatatatataatatatatactattataatatatataatatatataatatatatactattataatatatataatatatataatatatatattatatatattatatatatctgtcaccaaagtaaggtagagttatgatttgggacataagtgaccatcactctttaaatgcctatcattgtgtagattttagaaaatttcatcaaatctcttataagaacacatgcttaatgtgcactaagaaacctgattatcaaagcagtccctctaccaagaaaaccccctgcactccctagctcaccttctacccacccaggtattttcatttttatctgtgggtgtctagatcaggtttgctcaggactaattcacagcaaggtgagaagcaaactaatacaggtacctgtgatttggacagcactgctctcagggtcagggtcaagatcaagggccttactttgttctctggcctgtcttgtttgcttaggtcagggcagtcttgcttattttctggctgttgagcatcttgtgctgttccttcgacattttcactcttcacagttactaacttgtcttcttttgataggttcttttttttgttaaggtaagacctacatgataaaaatgcaaataaaacagaagtatattcagtggaatgtaaggcccgcctgtcctaactaatcctgtgttccttagttccctcctccagaggcagctgctatgattaccttctttcagatccttccatagtgagtctgtgcaaacataagcactatatagatatctgtgtggtcttaaagcctcccatctggctctgcccaccagtttgtgtgatcttttgctcatcttcagctcctacaatagctcatttatttggagccaaccctctctgctaacctgtcttggcttcactattttctactgctcacctgctctcatactgccactctgacttggtaagaccttaatctgggacagggagaagtagaaatcatcatttaggaagagtaaagcatttctagtttctatttccattccatattttctagccctgtgaaattaaattatgcctgttcatctgctactgactcactatattccacaagcaagcaatttgcatttttcttcacagcagcatctttttcctcaggatgctgtggcaactaatgttttaagattctaagaaaaagtcataataataaaacctttccatcctaggcatctaaaaattgaattgtgaccaaagcataaagaaatattattaaagaagctcaacagtttacaaacccagcaatgccatgttgaagattaaacctcgtaggttgggaattcatttagggcacatttgcattctgtgtttttagatgtggctacatgcacaagtcacctaacacatcaccacagaatacaatgtgtcaaagtatttagaatatgagagcatcacacagataagggagcagtttttatctgggaaggtgagaaaagggagtgagggagtaaattggcccatagaattttagagtttgaaggggcctcaaagatgagccagtagtgtaggctaagtacctttggctgcatcactaccaagtggttgtctagcctatggtttgagtacctccactgacagagtgctcgttatatctcaaggcagcttatttcatcaggctgccctattagaaagcttttctttaggccataccaaaatctattttctactgcttgttcctagattaaacttcttcgggctacacagccacaccaaattctttgcaagtatgaaagctctttatacatgtaaaagcagttttcaagtactcctgtctagagtaagcatttaaaattccttcagtggacatcaaatgacattgtttcccacccatccatcatctgtgtgggcacaaaaccttcacctatggagtaaaatgtgtcagttgcttctcttgtgtcttgtttttggcctaagtaagttcaatgagataaccacgaattaaaagaatcttggaaaggaatcaaatatggaagtatttgagaatgagataataaaggcaagtctggtcatacaatttcagaagcttatgcctttaatcagttaggctaatagtgaggccatgagcatagacatcagaaaactagggataaccctcaccatgatctgcagaatgaagatgttaggaaaccatagactctgtgataggaaagtcctttagcaatcagctaatgaaactccatcattttatagatagggagactgagatttgaagaggccaagagacatgcacaatgtcttacagctacattggcagagcaaacactaattaatccatgtcttttgatttccaattcagtgcttttctgtatgtgttttcttaacttgagacacaagcaacagccagatagtaaaggatatccttttatcaccttctctccagtcactgttaaccaattgtatttcactccaaaatatatttcaaaagttacagagttacgtaagaatgctcttaagattcttggaccgatctccaaagcatccctgccttattcaccaaaaacttagcagtttgtgtctttttgagttttgaattaatgtgagcatcagtgaggataagtccccattactgtgaggaatttgtacaatgagcgtctaataacatggataccacaagggagtattgataagacatttgggaataagaaaggaaatattggccaataatgcatattattgcgtgataaaaccctgatgtcatataatcatgttatggcaacatcattctaaacagaaactcaaaatcgctgaattcctccggacgtgtgtgcaatgtacatgggtcttcacgtgtacattggaaatgcacattaaagtggaaatggggagctgttgctgggattccaggatattggagacagacaaggtattcaccctgcaggcacttcgtggatatttttaatttgaaaaacaaggacaatcccaatgtctagatttcccatttgtgtagccccccaaaagatttcagtagcagacctcctatgagtctaggtccttctcaagccgagggttctcaggtagaaattatactgattgagatgagccgttggccttatttgagaatgacccaagtctggttttgtcagacttgggtcattctatttaaattcaggtatagaccctattttctagaccccattttctagagaatctgtgccaacaaaactttgaaaatttgaagacaaaattaacatttgagagaaaggattatagaaaacctgctaaatgccttcttaaaaatgggcccagtcctactttccaatcctataagatagcatgccatcacttatctatgccataatttatactgtattgattttattgtcacaactttgggaatactctgtcatgtgtatttatgatggcccataaatctttggaataacatttagagaccaagtcactatttggagtcaaggaaatagagggctgtgtagacagattagagcccattaatggacccagtgtgtagacctaagaaacctgcctaagataacttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtgaaataagaaagagagacccacatcccaggatccctggatcagagtggtgggtgacatgtaaagagaactgtgatttccccctacaggcttttccctggataagaaagtgttttctccactcaacaaaccctataatgggcctgttggcttcatgctccttcagtcctcctttccccacaactgggcctatgtgactctcagaatgaggccctgcaccttactccactctacctagcaaggctctgaggccctaccttgtagtcaagagagatctgaaggatccacagtcttaaaagcaggtcatggatgcagtatggctgcaagttgatcttggacttttcccctcagtcctaataaatagattgttgccaccttcctgggactggcacaccttgccttctcttccatatccaggagctcattatctgtctactacctactttctttaattattagagagcctggtccctaccttggctttgtacttggtgtctttttccactgaggactgaaattctgttgtccttttcagtcttcctggggtctgtgcttgtccactgccagaattctctgggatcactcatctgcctatccatggagatatttgtctaaggcttctgtccaagactccacaatgtctcatagcctactagccagcatagccttttgttgcttactgttgatcctcagtgaggctgctggcctgccttgcctggacctctgcctgctgcttattaccagaccctcttaaggtgtgcttcatctgctctgtggggacattgccctctaactcatgtctgggcctacacaacacagattattagtctctacttctcatctcttattggagaccctaacctcaaagccataatgggcctgcctagtctctatgttttagatttccccaggctggtctattctagtcccagccaagtttcagttataacttgtgaagactatatgggcagtccttgggccaggttgccctgcctgggccaggtttgtgggcccatcccttgagatgaaagctactgtgtctagtttctcagtcactatgcaccagttaatgaacaaccttgtaaaactttgcttttgatgaccttgtaggctaatttcaagttaatattctgagatggatgatgaaggagaatttttgtgtctttgtagcctacagtaggtagagggatgctgttgggaatttttgagccaccctgagaaaattaggtgaaggtgagaaatgcctgtgtgatcattttggaagctaagttgcatatgaatctaaggtggcattgttagtagtagtagtacttagtctagtagtattcagctccttgccaaggtgcttctggcttaatgaaatgacccagagcttcagctccatagcagggtcacgtgtattggctagctacatgtccttgtgttgaggacttacactttttgaacctcaattttcttacatgtcaagtgaggttttgtggatgatatctttataagctttcagacaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgaggaagtttgaaggagaggaatttcctgagtggagaggaatttcctgacctagagtacaggggctactggcttctttttgtttggtgcctgctgttgcttgtctggtagcttagactcaagttattctggaagcagttaaagggtagaagaagagcagacctaatgtgtgggactattcttataaggtatgacaggatttagggaccaggcaaagggtgcaaagccagtatcagctagtccaaggtaaacccagttcaaaggagaagagtaaatgacctaagtgagcagcaaaggcagaccatatttggacactaataatggtgaattttatgtgtcaacttgactagcttatggtgcccagttgtttggtcaaatactagtctagatattgctgtttagggatttttttagatgagattaacatttaaatcagcaaactttgagtaaagcattaccctccataatgtgggtgggcctcatccaattcattgaaagctttgagattaaaaaaaaaaaatgtggtttcccaaagaagaaaacatttggcctcaaaaccgtaacatggaaaccctgcctgagtttctaggctgcttgaccagccatgcaaattttggattccagactgtaacatcacttcttacccgggtttctagcctgtctgcatgtgcagacttaccatctcccacaatcatctgaactagttccttaaaatctctaacacctgaaaggaacaggactccacaaagaccaacctctctgacagtcctgctgaaatagtaaaacgatcaagcatagagtttttgtgctaaacattccaggggtgcttatttattgaggaacagtgtttctaatcttcaagaaattttattccctgagaaatttccccatttattttaatttgcttgtgcagtcttttaagtgggttatattactttgtacatggatcgctttgctgtgcttttatatgaaaatcattattagtagtcaacataagatacaaagtgtactgcttctataaagcttatcttacagcatatatatagcctgctgaaaatatattgctcatttgttattaaaaatcctacccaagtaaaaaaaaaaaaaaatctctctctctccctctctctctctctccatacgcagacacacacacacacccccatgcacgcacgcgtgcatgcactatggttggaatgttgtttgtccccttcaaaattcatgttgaaatttgattgccattgtgacaatatttaggaagtggggcctttgagaggtgattggatcgacagggctctgccctcatgagtggattaatgctgttgagtaggagtgagtatgttataaaagggcaagtttggcccccttttgctctctccctctcagctcttttgctcttctgccatgtgaggaatagtgtttctccctctggaggatgtagcattcaagaagccgtcttggaagtggagacagctttgactcgatgccaaatcagctggtaccatgatcatggacttccagcttccagaactgtggaaaacatatttctgttgtttataaattacccagtctgtggtattctgtcagaacagcacaaaatgaactaagacaatgtgtttgtgtgtgtttatgtgtgtgcatgcacatgtatgagcgtgtgcatgtgtgtgagtgtgtgtgtgtatctcctatttgttctctctggataaccatgactgaaacagatatcatgaagatagcaatgcggctttgagcagagacagttgcaggattatggagagccttgagtgagctgtcattatgagttcttttaccccaatagtcataaaatattgagtaatatttgagtaataataattaattattactatgtctactaagtgagcatatattgtgccatagaggttggttggcatgatttctattgactcagatttctgagatgctaatccagagcctgagtggaagtctctcatcttcctgtcagagaagctttactctcctgaagagagcaccaaaagctgggtatcctccatcagggaatggggatcagactagaaaaggcctccagctctgtcaggttaatactgggatcaagaaggactttttatattaatggagtcaatgccattgaaagttagcattcatttagtccacttcttcattgtatacatagggagagtgaacctgagagaagagaagccacctttataggccacacagcaagttggtggcacagccaggcctcacactcacatctcctgacaataagtaaggtagagaagaaaggagaaggaaagagataaaggttgtttgctagaagagaagtctggattccggttgtgctttttctatgagccatttggtgagtaattgtcccaaagtttggaagtgtcccagttttcacaactggatagaatggagggaaaatagaaaagtttgaaaagtaaagtgaaataacatagacaacatatttataagggcccctaactgctaaattacaaaattgaaaatgatctatatagttttcattgatgagtaaatctgctttctggtggacttctctagtggcaacaaggctactgcactcagtctcaccaccttgaccaaaggccaagtttgcccttgttaaaataaaggtacactgtgcttgctgtggggccaggcttccttatttctctcctatatttgttcaggaatttggttctgtcccatgaggatactaaattgcattgatcaatgaaaatggcatctgtgcttgtttgttttaacttgactttgatagcttcatccattaaactttcaatgaagttgtaatttctttaaaaaaaaaaaccctaaatttaaaaacatgctggcagttcataattaccttggtatatatcaagatgaatcagtgaaggtgactctctttcctttgcatttagtattgttgctttgtgcctgtattttctatttaggatttattagtgtaaatcccccttatacatcattgaaagcattaggatttatgtagtgttaaatccatatcaggatttatatggaattaaatccaatctaagagacaggtggataacctagtggggttttgtacccataatttctaccgctctttgtggaaaagcatttcattacaaactttcagatttgggaaggcagtgttctgcaaatggcacctattagtaccaatgtggagcgttttactgcactttccatgtagtccctgggctcctcactgagaagcatcctcatggcaaagcatctttcatggccacgaggaggacattaacctcttctctgctccttccctgtttggagcacagcacagctttgattaactctttaaagagccttctgtttacaccctctcacagatctgcagacagtatttgcaaagcacattgcaatttttgacagcaggcaccactggggtggggaagatacttgtcagctttttcctttggtgactttccttccatttttttttatcttttgagggaatgaaaactgctccaagttggtgcttgctattctccttttttatttcttttctcttctttgtatatgcttttccccatcccatataccaactgatggggtgattgagtgactttcatccattcagtcaagtatttactgagtcctacttcatgcaaagtactgtacaatgtactgagtttttagagttatttctttctggggttgttgtccctttttaaattataaaaataatacatacttatggtaaaaatgcacagtacaaaagcatataaaatgaaaagaagatcctcttccacatcaagctcctagtttcactcctttgtataacatcaataacaatttcttacatatccctataaaaattttctatatgtatataagtgtgtatgtaatgtatacattcatacatatatgtacatataggtaacatacacacatttacttatatatgctttcttagaaaactcagactggagcatggtaaacacaagttttgtacatccacttccatgttgtatcaggccatttgctttgctataaagaaatacctgaggctgggtaatttacaaagaaaagaggtttaattggctcatggctctacaggttgtacaggaagtttgctgctggcatctgcttctggtgaagccctcagaaagcttacaatcatgtggaaaacgaaggtggagcaggcacatcatatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctggaatcgtgggggcattcccaataataaatgtctagatggtgtgtttattccagttccaatccaatccaattcaatgaatatttgttgaatgcctgctgtgaagaagataaagaatgaataagacatggctctcactctccaggagttcacactgtaatgagaaattgacatgtgcactgttaattctcatacaaagaaggcaataataaaggtctatacagaagtttaaacaaggtgttaaggggatattggaggagtaaaaaattatgtcgaattagagtatctggaaggaatgctgtttgaaagaaggtggttttgagctttgtcttaaaggggtgatgagattattataggaagacattgaggtgaaaggtagtttagtttgaagaaccacacactctgcaggtgtgcagtcccagggaacgcatggcaattagtctggtaaggtggagagcagcatggcatacagctggagcggtaagtccgacccagtttatgaagagccttgaatactagactaagagtttggacttgctctgtaggttaaggggactcttgaatacctacccctcaaaatcacaaaggagtctgtttcctgtcatcatagcacttggttcttctcggtagccccttttacagacaaattccttctagttacatttgtactcatttggtgaagattctctatgggaaatacttgactttaaaaaacttgacacatagtttgatgtaaacgactctgatatatcaataatgtattttattcatttatctcccaattgtgtatgtaactacatatactttgtataatcattgactatgattacagtctgtgttgatataacctaagagtggttatgcatgatctgggtggtattgcatctggaatttatcctactctgtaacatgttccattgagcttacaccaaaccagtctagctatgccatcagatttctctttaccagctctatttatggtctttctctgacattactataagaatgtcaggttaaattatatcagatgcttctctctccaagatatgttaactttgctccatcctctttcaccattcagcttgtcattctatcatgaacaggaattagcttcgtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggactttttttttttttaaagaaaaatggaacacagcagtttcatgactcacaacaactcttccataataaccaatgtgataaaaacattttttcagggaaacaaatttcagttttagccttccaaatgactattacgaaaattaacaactaataaaaaattgaaatactaaaagacatcatgtatcctctcaaactatttatttattgtactcatacatattcttaagtgcaataaaatctgcctagaaatcattaatccactagtatatagtccttacttggtgctggcaactgaaaatttggtctttttatatacaaattgttacacgcatgaaaagtagtccaataatggcactttttataggttatttcataagtactcttggttggacatatgctaaagtattgttacaggttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttc

SEQ ID NO: 9 - DNA, 5124 bp, Artificial Sequence
  Based on Homo sapiens sequence
cataaagtatttgctctctctgcctgtacttattggaacaactcgggaagtccacaaggacagtccaagtcatctttgtcgtctacttcctattgcattctcagccttgtttcctttttagaaagagcctgttaactatcataagtcaaaaaacagcattctgacctctgccctgtaacttcctcttcttcttataaatacaagggcagaactggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaaggtgagtccagtgagctttctctcagatgaccaggttcatggtaactcaagctctgtggcagagacacattgccctcctgtaactactctccatcccagacgtggtcatggtactcatttaaaagcagcaccagagtatagacctggttctgtctgcaggctttggaccctgggaggggaatatacacatatggctggtccaatgtggggccaatcatttcccttttcacagcaaaaattatttgataccttcccttagcagacataggactattaagtgctagattaaaagaagtgtagtaaaattacaaatttgtagaaagaagcatagaattgtatgatgctaaaactgttacataccatctagtagtatctatcatatcattttggagaagaaatggaacaagccacacaaatgactcaaccaaggtcacctaaccatcgtatttttttgtttaacaaatgcacttctagtacttcctatgtacagggcaggcactgttctaagtgtcttacagatattaacacatcagttccacctaacaaccctgtgggatatgtattagattttaaaaaatgcaaattttttacttttgtagggaagaaacaaaacatcaacttttatatggtttttcatattattattattgacattttacaaatgagaaaactgaggcacagaaccttagataacttggtagatcacacaactattaagcggtggaattaaaatatgagctaattaggaagtagttatggaacgacaaggccatttaagatcttttttttaccttacccaaaccatattgagcatattaaaatatacccacatgtctcattacatataattcatttaatgtaaccatataagaaataagttgaaaacactggaaagcaattgggggactaattcggcagctgaatcgttattgccaagtctttatgtttcaaaatgttaagtaaatatcaactttaaagccagctttaaaattattaatagtatatttaatataattgttaaattatattaaatgcatagtcattaaattatattaaaagtatatttaatatccttattaaattatattaaaagatatttaatatagtcattaaattatattaaaagtatatttatttttaaatatatgaaaagtacacatatattatattaaaagacacatgcacatgtatctttattgcagcactaatcacaatagcaaagacttgaaaccaacccaaatgcccatcaatgatagactggataaagacaatgtggcacatatacaccatggaatactatgcagccataaaaagaaatgaattcatgtcctttgcagggacatggataaagccggaaaccatcatcctcagcaaactaacacagaaacagaaagccaaacaccacatgttctcactcgtaagtgggagttgaacactgagaatgcatggacacagggaggggaacatcacacactggggcctatcggggagtggagggtaaaaggagggagagcattaggacaaatacctggtgcatgcagcagccctagatgatgggttgataggtacagcaaaccaccatggcacatgtatacctatgtaatgaacctgcgcgttcagcacaggtataccagaacttaaagtcaaataaaatttaatttaatttaactttaaaaaaagaaaaagtctatttaatagttattacattatatttaaaatatatttaatagttattaaattatattaaaagtaaatatttattatattttattttattttgagttggagtctcattctgtggcccaggctggagtacagtggcaccatcttggctcactgcaacctctacctcctgggttcaaacgattctcctgcctcagcctccctagtagctgcgattacaggcacatgccaccatgcctagctaatttttgtattttttttttttagtagagacgggatttcaacatgttggccaggctggtctcaaactcctgacctcaagtgatccgcccgccttggcctcccaaagtgctgggattacaggcgtgagccaccgcacccggccaaattttaaggctagctttattctgtgagacagtcaattgtggaaataaactaactttaaggattaaaatttaaaagaaaggaaaaatgtttaaagcttagtttcatttgcctaacaagcataaggcagctccacaatcccatttccaaagcacttggcgctagatgaattttggaatgcagaatttctcaggttttaaaaagttaatatgatatgatgcagcaattctatttctgggtatatatccaaaataattcaaagcaggtacatgaattgatttttatacacccatattcatagcagcattattgatgacggtagccaaaaagtagaagcaaactaagtgcccatcaaaaggttagtagataaacaaagtgtggttcatacatacaatggaatctatttggcctcaaaaagtaaggagattcccttgaatgttgaagtaagaaaaaataaaaatttaagtaaggagattctgacacatgctacaacatggataaacatcaaggacattatgctaagtgaaataaaccagtcacaaaaggacaaatagtgtatgattccactcacatgaggtacttagtcaaatccacagagacacgacacagatagtgattgtcagggattaaggggaggaagcatgaggagttgttgtttaatgaatacagagtttcagtttcacaaaatgaatgaacggccgtgaaaactgcatagttatttgagtgtatttgatgctattgaactgtatacttaaaatagttcaaatggcaaattttacgttatatatatatatatataaccacgatttaaaaatgatttagtaaaaaacttaaacatatattgatggtacttatccctgatgaggcctgggaacagtattttaatcaaacacagcaacctcctgtaacaaacacatgaatatttctactaactgggataaataatgaccataatagctgcacttcacttaaagggatactgtgccaccatatgagctgatgaacacctctctgtttccagagccctgtggattccagaaatgtgtagagagacttgtagactgtgtcacatcatgtagacattccattaactgaaccatgttagattttgaggtttcttttagtatttcagagtcaacacagtgttttcatgtctacattttcaaaaggtccctgaaaaatctcagggccctaaaggaataaatgggccaggagtcaggcctagagcccagacaggtggtggtggtccagcttcagggacctttctgcctcaggaggaggatgagcaatggggtgggtggagatgctgaaacaatgctgccgcccagtgatttccttccctgtcctgtctgcttcttccagatgcagagacagagttcatgatgtcaaagcttccattggaaaatccagtacttctggacagtaagtgatcagatacggcatatatttaaaagcagccagcaggtgcaggtctgcactatgggatccattgtccctgtttacagaatgggaggagaatgagagggtcctgagggtggtgaacatctccaaggaagatcaggacgggctatgggaaccccctccatagatgccttctctgttcccctctggctgccccaagagtctgctcctttggggcagaaggtgctctctgatgcctgcaggtgtctgcagatgccttccccttctaggggaaattttcctggtcctgctctggcccaccctgagtgccctcagacacacagctcaactctgatgagggtctgaagcagggagatgccagcaagtgctggtcacggaggaggaaacatctcttctgagccatgtgccttctcaccctccacagtgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatgtaggtgccaagctcaccaaacatgtgttgagggagaaggactctgtagcatcttgcagggaggacctgatagactggtgtccatcagggcccaccctctggatcctgccaggtatggggcagctgtgtccttaggaagatcctgcagggcatcggggatgagacactcccagggggaaaagggtggggaaggaagaagaaagcaggcacaagtctgcccaaggatgctcccatgagtcactagggagtcccacaggctgagggggtctcaagagcacaatggccctgagctgccatcagcagagaatgaaaaaaaaaagaaaaaaaaactggctatattgactgggaaatctgaggggcagggagaatggggccccctgtccccatgtgctggacacacctcagtttgtaacttttctcccccttgttccctagcttcctcaccaagaaggggcgacgtttctgtgccaaccccagtgataagcaagttcaggtttgcatgagaatgctgaagctggacacacggatcaagaccaggaagaattgaacttgtcaaggtgaagggacacaagttgccagccaccaactttcttgcctcaactaccttcctgaattatttttttaagaagcatttattcttgtgttctggatttagagcaattcatctaataaacagtttctcactttt

SEQ ID NO: 10 - DNA, 3411 bp, Artificial Sequence
  Based on Homo sapiens sequence
cctgtgggagctcagatccttttaactagggttggagcctggcgccctctggcggcgagctgcaacctctacccgccaaacccaaggccaggctgagaccagccaccaattcacacccttgttttgcaagtggaaaacctcagtccagagaaaggcccgggcttgctgagacagaatgactttcgtatttgctttgtggaatgtaagttgtctggtgaagcattattgctcttcttgttaaccaaaatcaaaattgagagggtcaaggcagaacactgatgtttgctgagccttcctttattctccctatcttcagatgggtgtgatgagcctattttactgagaggaaaagtgaagctcagagaggctaaagaaattactttcccaggctcacagagccagccaatgcagagccaggatttggacccaggtctgtctgactctaagcccaccctgccagatccctggagtttcacctccagtcccctcttccccaacagtcccccccatctcccaacttcttggtatactgatctgggacagcagaacgtcagcagtcataagtccttagctccgtacttggtgtcaccgtgtcattcagacacagccagttaccactccttggcctaagcaggggagggagactgggggttgggaagagacgctgggcaggggagactcaggggcttctggtggggatggattagtggggttgagaatctaagccagaattcggaacctcggtagctatgagatcttgagcaagcgtctttacctctgtgagcctcaggtttctcagccaaaaagtgggaaattataacaatactttgacggccccacttaggaaaaaaaacagtccaggtttggagttaaattttggggtctgactggctgtggggtttggggccagtgatttgacatctctgagcagatttcagatcctgaatctgtaaaatgggttgttgtggggatttagtgaggtgactgagctggcagcactttggaaaatgtgaggctttacaaatgaagctggtttttagcacttccctggaatgggggctctgagatggggagggaaatggatactggaaaccggcacccccctcaacatttcccctgaacccaggcacatgagttctcattctgcatcctatgcacccaccaaatgggtttctccaagcctggcaccccactcctttccaccttgcctgaggacctgaggccccttccctcttcccaccttgttctagttgcaagctgcagaggatggcctgagtttccattcttcagcctggaggctctggctgtagcctcagtcttccagctgcagcctcaatcttctgccccaagagaatccgttggatgatttgggttgatctttgggaggcaggagagctagttccaaggcctgtgaccaaaacctttcagtcactctcgagtcccagaaccccatctttcttgaaccaagcctgctctggtgcccaaagggaaggggtgtcagtgatgggggcccacaggagacttttactgtggtccagttttatctgttatgctgctggtctggcacccacagaactgccctgtccccctcccgtctctggcctcagtactggcgttgccagtatgaggagacagtgagaggaggggtgagggcttcggagtgagagaggctgacaggaggcggggactctggggggctgaggactataaagcggcccagccgagggcaggggcccatccggcctgaggcaggtgctcgcttggtctagtgcccatttactctggactccgggtaagtgggctcagcctgcctggggctctgggggcctcccccaggctggggcctgggatggagaggaggtggtgctttgcagggccaggggccttgggaggcctaaggtcctgcttgggtcttgctttctgcatctggacagacctgtcacgctagaagagccgtctgctgactgcacgtgtgtgtgcacactcgtgtgcatggctgtgaactggaatgtgtgactgtgaccttgtgagtgactggggtccctgtgtgagtgcctttgctggtctgtgcaggacgacatggacagtagcgtcttctccaggaccgatatctgtgtctctatcgcagggtggagggccagacccacaaggccatggatttctgtccttggcttcccgagttcattctgtgtcccccaccctgtgggtgacctggcatgcccttattcccactagctgctgcctcctgggagccatgaggccctggatgtcatgagtcccgtgtctccaggactcacatccccattttctctgctatacttttctaacttgcgaggccctggcttgctgggctgctcacaggacaggctgtccgtgccttcagagcagtgtctaggaggtggagtggccagcttggagtggccctttgctctgcccccttgtccccaggcttggagaaatggatgatgggctaaggggctggatagttgggccctgcttcctgggcacgggaaaatctgcagcccgggctctccacctcccctctgcttgctcctcagatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtgtgtgccacagttggggagagagatcccagcccctgggaccctgggcccactccacattcctggccacaccctatccccagccccagccccagccccttccaggcctgctcttgggaaaacagggcatctgtgctcaacaggcctagaccaatgtgccctgggcaagatggtgcctacaggcagatatgaaacaggtgggctggcacctgggcacagtgcttgcccctgctgcctcttccctcccaggtatgggaaaagacacaaagaggacacgctggccttctcggagtgggggtccccgcatgctgctgtccccaggtgagtttgactccctgccctgtctgtccagctccctggagctgaaatgggggtggtgggactgaatcagggcttggaaaggtgtagtggggggtggaagagggagaacaggagcccagggccagcctgaggcctcctgagggcacgaggcctaccccctacactgccatgttctgccctgtcctcacagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaca

SEQ ID NO: 11 - DNA, 12842 bp, Artificial Sequence
  Based on Homo sapiens sequence
ttagtgccttttctcaggggagaggccatcacttgaagatgctgagtcttctgctccttctcctgggactaggtatgagccttgtcttttgaggagtctggggttaatgttaacactgggtggaaaggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaaccttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatctaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccatggcttcaagctggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtgtggccttgagcaagccacttcacctccagaaagttcatttgatcatctgtaaaatgggcaatcccataggtggttgtgatgataaaatgaaaaaaacatttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagctttggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctagggacctctgtcttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcagccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaatgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggaaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccaacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaacgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggatgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaatagctaaagcccccagtatctcttcagtctctataccaataaagtgaccctgttctcactgtc

SEQ ID NO: 12 - DNA, 129864 bp, Artificial Sequence
  Based on Homo sapiens sequence
gatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatgaaaactaattgcctttttttggtgtgctcagaacattaaccaggtggtatttgttggaaatttcttgagaattaatacgatcgccatgcggcttttggcatatgctttggattattggtccaaggggcagttgaaagcacttttttcggaacacgaggtaagctgacttgttcgttgtggtatattatgtacacagagggcttgtgggtcacactgtcatggaacttgaggtagagggtggaggtgaaatgggctgcagtgtttcttttgttttttgtttttttgagacggagtctcgctctgtcacctaggttggagtgcgtggcacagtcttggggctcactgcagcctccgcctcctgggttcaagcagtcctcccacctcagtctcttaagtagctgggattacaagtgtgcgcccccacaccctgctaatttttgtactttcagtagaaatggggtttcaccatgttggccaagctggtctggtctcaaactcctgaccttaagtgatctgccagcctcagcctcccaaagttccaggattacaggtgtgaaccactgtgcctgaacttttttggtagtttaatttcgtaacatttgaaagctgtttcttccctgatactaatgcaaggtaaattttgggttaatttaattgtaagcttaaggaattttagagaaaaacccttgaacattcccctatatttctgatgccatatttttgtctgaactatcctctatattttttctattgcactgactgtgtcattactctgggttctggttttttcatttttttcagtgccagtttttatatattgttgtaattcttgtgccagttatttaagatgcatgttgtaaaaatgaatagatgagtaaacctctcagactagaaccatactatcataagaacttaagtacaattgtagacaggctggaaatgatgaaatggaaaagaatcaaattgctcaacctcatagcctgtcttggaaagcactcttatttttcctatttggggaaaaagaagcagaggtatggaaaggcgtgtaggggttctttcttcccttcttggttgtggggcagttgaactattctttcaactgttcttggattttagatactgttattatgaacatttttcagaattgtattgcatatttagtttaacagtctatatgaattaaaggaaatcaaagtccagataatagcacagatttgaagtgctagagattactttttcctttaaagttactttaagtttttctttttaaattgctttagttcatagttgaagtccaaagtacacaaatccccatatcaaaaagcttaaaattgaagtcatctaacttagttttaaaattctaacattactgtatttgtaaaccagcaccgaattgccattaagtttcttacagttcatgtttctgtatacatctttttttgtgatctgacttattttattttgctttatattagaattttttaaactcgaatgttagatctttttctgctttatttctgcctcttgtttaaccttttcctaggtagaacatggagattagttttttaagttaaccttaaaaaaaaaataggctgggtgcggtggctcacgtctgtaatcccagcactttgggaggctgagatgggcagatcacctaaggtcaggagaccagcctggccaaccatggtcaatgtggcaaaaccctgtctctactaaaaatacaaaaattagctgggcgcaatggcgggcgcctataatccccagctactcgggaggctgagacaggagaatctcttgaatctgggaggcggaggttgcagtgagctgagatcgcaccactgtactacagcctgggcaacagaacgagactctgtctcaaaaacaaaaacaaacaacaacaacaaaacaaacaaaaacaccaaacaggccaggtgcagcggctcacgcctgtaatcccagcactttgggaggccgaggtgggcggatcatgaggtcaggagttcaagaccagcctgaccaacatggagaagccctgtctctacaaaaaatacaaaaattagctggacgtggtggcacatacctgtaatcccagctacttgggaggctgaggtgggaaaatctcttgaacccgggaggcagaggttgcggtgagccgagatcgcaccactgcactccagcctgggcaacaagagcgaaactccatctcaaaacaaaaaacaaaacaccaaaccgatatcatcataatagttataagccttcgtgaaattcttggttgcattttgtccttattgctcgctgactttgtttttcccactgcttagctttgctggtccatttgtccctgtgttttccatttgcattcaggcctttgactcttgtgtgcatctctgcccttgtggaactttgatgattattttattttatttttttatttaagttctaggatacatgtgcacaacgcgcaggtttgttacatacgtatacatgtgccatgttggtgtgctgcacccattaactcgtcatttacattaagtatatctcctaatgctatccctcccccctccccccaccccatggcaggccctggtgtgggatgttccccttcctgtgtccaagtgttctcattgttcagttcagaactttgattattttagcctctctgagccttgaaatattttcttgccctcacattgaagtcactttaacttttgttgtgaaagcttcgtatagattctctcaagcgtttcctctttgatcctttattctcatcttagcacgttgtagtttataaccacctgtttctgtcttgatagtagcatcctagtcttcagtggaccccccccatatatatatataatggttaactgtatcttctatatttttattataaaataaaaggtacagaaagctgcctaaaacaaactgtatagtgaactattaagacaaacagccttgcctctgtatttcagctgtgccttgtcctgtagctgctggccgcctcacatcacagattggtgtggctgcctttattttatttatacacaccaaaaccaaagatggtcaatatgcctttcttttttttgttttttgagatggggtcttactctgtcagccaggctggagtgcagtggcgcagtctcggctcactttaacttctgcctcctgggttcaagtgattctcttgtctaagcctcctgagtagatgggactacaggcacgtgccaccgcacctggctaatttttgtatttttagtagagacacggggtttgccatattggccaggctggtcttgagctccagacctcaagtgatccacctgccttggcctcccgaagtgctgggttacctgtgagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcctgtcctctgttaggggtgaatcttgaatccatcttatctcttactctccctccctctcccagctcagtcgggctctcaccctctgtgacccacctcacaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaaatgggtatgctgtgtgtgggcagtggttggctttaacactagtcatcatgtgtaaggtgatttgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggcagttccacgttactttacactaaatcctgggaatgaatgtctggagagacagggcttcttttcttggcagaatttccttgggtagtgggcggactgttctgatgcaagtgggtacactggcagaagcagcacaatctggaggactaacatgagtcagcagggccactagaattgacaccccctcaggggatcagggagaatctggtttttctttcaggctaagtagaaaaggaagaactgaagtgtctgtcaaagaactcatggggagtggggggtccttcagggcactgtggcacttgggaggtgagtctcagaagactgcctgaggagagtgccaggctgcaggtgctcttggtaggggctgaagcttttctttctgctttgcagaataatttcaaaagcctttcccaaggagagaatgcaccttttatatctgaggtcttaagtggtgcccatattgctgttgaaggcaaggatgggcctgtacaaagcagccttggaccaggagggaaaaccccaaggctctgcagcctccctgctcccctccgtttaaggctgtggtcagggagggatgggcagggtgccagccgcatggaggcagcagagacacccgtgttccagctggggcaaggggaactgatatgtgggctgtgggctgttccactaggcgtggccacctctgcacatgggccttggcacttaggaaatatgggtgctgctgcattgggaccttgtgtgggtgcagagcaggatggctgctgcgtggagggtaattttgtcccctggagagtgattggtgaccctcttccctgctgctgctgtttgcaggctcctggcctatactacctctgacgccctgatcctgagttcctctgccctcctctgctgccagcagcgctgttggtggcctcaccctcctccagtacccaggcaccaaagatggcaccaccatcctcctgcttgtaccacagggtgctgctccctgggccaactcctgtgaacttgctcacttcccatggagaccgaggccagggcctgcccctctgaggcccctgttttgtggtcctgctgcctctgctgtgctgcgttcaggaggttgtccactgctcgacgtgggtcaccatgcagcccttgctgttcccacaatttaacagaaaaggaaactgaacggatgagtaaggctgcccagggtcactcagctggaaaagagtagagctggactcaaacccgggactgtctgtctctggtgcctgagttgggaagacgctgttgatgtccccttctgcctcgctttgagcttcctcctccgtgggccctccccctactctagagaaactagtccattccctcatgttccaccttgtgctcagtaaaccctgtcactccacagcagggtttttgagacagtctcgctgtgtcacccaggtggagtgcagtggggcgatctcagctcactgcaacctctgccttccaggctcaagcaattctcctgccttagcctcctgcgtagctgagactacaggcatgtgccaccatggctggctaatttttatatttttagtagagatggggtttcaccatgatggccaggctggtctcgaactccagaccccaggtgatccgcctgccttggcctcccaaagtgctgggaatacaggtgtgagcccctgcgcccggctcacagcagggttcttgataggccaccagtgaatcccatgccaccgaatctggcattcatttcacagcctcatctcagttctcactcagcagagccctcttgcctgtcctgccacccaggctactaatgttctggttcattctctgctgacagttagctgtggctgtcctcagcctcagtcctgggtctccccaagcagtcattagcatcaccttgactgatttccagggaacacttcaaccaccccttacctctgagctccagccccgagacactgccttctctctgcatttgttgatctctgtgcagcagtgcccacatcctcatcccagcttactgccgtctcaccaccttcaggttgtgaggtgcccataaactctgctgttaccattgccacttccctgtcttagcagctgtccctttcagtctgccctccactagtggccatgaagggggctgtgaccgtggtccaggtgagaaaggaaggcctgaactaagatgggaggtgggtggccagaatggagaggggagaagtggatggccagaatggagagatgcttagagggctgtgttgggaagtggtgactggatacaggggagggaggagagatacaagagggcacctgggctcatttgtggactacgtgattttgagactccaaataagcactgggtatttgggttggagatacagagctgagaatgatatgcatgtaggtgggcaaagcaagggggatttcatgagttctaaggtagggtgagaaaaataaccgagagttgagcagtgacggaggaagctgcaaagaaaacgactgctcagggagaggctggccaggggcctgtggctcaggggactgagaagaggagctctctaggcatctgaattgaggttgcccacaattggttgcaagatcgtggctggccttgatggaagctgggaagccactcggtcctagtgaggggtggtgaggagagcagcaacggccacacaggaaggctttggacgttttttctcctgacactagttatttccaggcctgggatatagctaggggcttggggtgggggcaactctttgcagggtggtgtggcctgtggaggaaacaggctcagttccactactttggccaggtgcaatggctcatgcctgtaatcccagcactttggaaggccaaggcgggtggatcacctgaggtcaggagttcaagaccagcctggacaacatggtgaaaccccgtctctactgaaaatacaaaaataattagccgggaatggtggtgcgtgcctgtaatcccaggtactcgagaggctgaggcagacagttgcttgaacctgggaggcagaggttgctgcagtgagccgagattgctgcactgcactccagcctgggtgacagcaagactgtctcaaaaaaaaaaaaaaaaaaaaatccgctatttcaggtcaccctggtgctggcgttcacgtggaagactgcttatctgtatccagctgtttgcagagctcagggaggccagggggcttcagactccactgtactctgcattccaggattctctgttctctggctgtggtggcctgacacactcttcaccactgaccccacccccgcttgcacactatgccacaggaagggcaggggcttccatcacaatcactcagtactagttaccagctctgatagaattactcaccttgagtttccaagtcttgctgaaggtgcttgcgtaagtggcacatggatgttccctctgttcaaaggcatatgcacaacactatttttcaaaatttgcttttatttacacgtttgagtcaattacatgcatgttttatttttgaggagtgattagcaaaatgcattaaaattttaaaatagcaattaaatatacaaaaatatagcttacaaaaaactgcgaatgtttaaaaatattctgctgcagaatttttagtgtacaaagacgtctatgaaacctgaggttcagcatttcataaacctttttttgagggagttacacaatacctagtgaggaaacccgagggccaaactacaagacgaaaaagtgccccgttcctggcaatgatgtcagaagaccaagaggcgatagttaccagcaacactctaggaagaccagctgtcaccagaagggagttcctaacacttgccacacctgctcccccgaccgggggcctgggagggaagggcagatggagaggaacggtgtgcagtgggcgtgagatgcagatccaccaggcttgggactggcaaagggagctgagaagagagttcccccaaagcacaaacaagtctgctgacactggtggggcccttacagtcacagaagtaaggactggatggtaagccaaaggtgctgatgcttggtcaaaaagtggagtacatctttgcatcttgtaacaatttgggctctacagctgaattggcaaagtaaggtttactacacaagcccctctttttcttctgatatccccactcaaatggaagcacactccccagcacatggggatcccttattaatctttactaaagaaccgtgaaccagcattttccagttatcaactggatatttaggcatgaatctggacatgtccatctgcttaagaaatctgcttaagaaatctgtaacagctacaggaaaagacacacccagggccagagattctacaaatgccagaagagtggatgtgatagagaattttttctcaagttttgggttagggcaccagttgcaattttaatccaggggaggatctgggctgctgctgtagggggcaagtacaccagggaggtgggtgtggacagaggcactgggcagctgctgggaagcgaggcacaagtctgtgcccctactcccagggctgcctggaggaagcagctctaactttcatcagcggggacaaaaatgaacttaaactaaaaaaattattggccgggcgcagtggctcacgcctgtaatcccagcactttgggaggtcaaggcaggtgcatcacgaggtcaggagatcgagaccatcctggctaacacggtgaaactccgtctgtactaaaaatacaaaaaattagccgagcgtggtggcgggcacctgttgtcccagctcccgaggcgggagaatggcgtgaacctgggaggcggagcttgcagtgggccaagatcgtgccactgcattccagcctgggtgacagagcgagactccgtctcaaaaaaaaaaaaaaaaaaaaaaaaaaaaaaaattgttggggtaatttctgttgtcaaatggaaaacaaggcataaagggaaaattctgtaggaagcattttcttttcttgtgtgtttttttgagacggagtctcgctctgttgcccaggctggagtgcagtggggatcttggctcactgcaacttctgtctcccgggttcaatcaattctcctgtcccagcctcctgagtggctgggattacaggcatgcgtcaccacacccggcaaatttttgtatttttagtagagggggtttcaccatattggtcaggctggtcttgaactcttgacctaaggtgatccgcctgcctcggcctcccaaagtgctgggatgttgggattacaggcgtgagccatcgcgcccgaccagaagcattttcttttcaaagtgtgtgcacagagtgaggaggccagcctgggcaacatagtgagttgagacctgtctctacaaaaaaataattacgaaaattagccaggtgtgctggtgtgcacctgtagacgcagctacagactgaggcgggaggatcacttgagtccaggaagttgaggctgcagtgagctacaatggtgccactgcactccagtctgggtaacaagaccctgtctcaacaacaacgaaaagttgggagggaaagggagtagctccatgaactgacgctggacattcaggcatatccacatgagactcactgtgcacttgctcagtagctaagatgtctgccccacaaaatagaagccttcagttgctgctgctcaaactcctgcatcaaagacacaagagcttgcctaagtgaccacaacagttgcagccacacatcaccactggtcctcacttggaactggccaaggtaggggaggggccagcagctgtccaggcacctgcagaggctgctcagagctgggagaggcctgtgccactgctgtcagctacagagcctgatcttgagcatcctgtcgcagatagaaagtcaatcagaaaaatctggttgtgctcttggattagctgggcatttggggtaagggagggactgcagattctgatttgtacagaaaactaaaatttcagtatgttgcaataaaatgaaaatatgtcttactcaacaggagtgtgattgcaaaaacatcccccaattctgggttcacattttgtattctgatttctgggatggctcttcccacattagtaggagcgttccttgaatacacttgtctggtatcacatgagtagaaaaggagaaaaattatatagacacacatacacatgtgtgtacatgcataaatgatctctggaaggatacccaaggaacaaaccaatagtaggtattcatggagtgaggagcggagcttgctaggcatcaggaactcaagaaaggcttttaactactttatgatttgtgaaccacatgaatggattacctattcaaaacattaagaaagaaatattcagcactgaacaaccaagtcagagttcactgtgggcaaaggcagagatgaccaaggaagaaaggggccaggtgaacctgggcctcagggaaagcccctacagctcaggaagctttttggctgaggttctgttcctatcaatcatgatggcagaggagcccatgtaacccagatgatgttatgtggtatcagcagcccccatgacaccaggcctgctgcctaccaggctctgggcaccagctaacccccacaagaggtgccagggacgttactacaatccctgggtggtagctaaggaagctaaggaagagactgagaggctaacctgcagaagggcctaaggctagtgagtgacaagaggtgattccatcactctctgcctggagctctgggtatactgccctggatgtatcaggatgtatttcataatgcccaaaaagcctctgagaaaaataattcctagttgttcaaagtagcttagagcgggatcaggccagggagatgacatgattttgaagtggggttgtgaaaaaggacaaggcccgaggctatttctctgatggatccaaggggcttggcactggggaaaaggatcttcttgtcaagaacagggtatccggcaatggtgggaggtcccctgtatccctcagctcagaccttcccaggggccacctgcccctatttggccatttctgtcctgccttccctggctaggcaagcataggcttcaaggaccttatctgccagggacaggcctaaccaaatcacacgtggcaaagaaaagcagcagatgtcaacttcctagtgtctgatactgacccaaccaggaatcaagtcaggctggttttgttccctgtttctgaaggcagttgaattcagttgtacccctagcaactactaatggttcagccacccgtggagtccagttggggctgagttatgctccactaacccatagcagaccagcaacattctatctttgagctgcttaagaaacacacaaaggataccagccagtggtccaagagcagaccagaatccccacgcagctacacagtaacaagtcccagcaactcctgaagatagatgcggaaagggtgactttaccatggggttcgagtctgagccaagagagttataaaggggtccctaactcattcctttttcaaaataaataaaaaaaggactgtctttcaaacaaaaaccctgcgattttaatgagaattaaaggaggatgtaaattaaaaggcctgtttgtctgtacagcaatgcagatgcgcaggcccatcctggtggaggacccagatgcagggagcaaatattcgggttgtgttgctaagagtcgcaggaactactgctagtgatactaggcttgctgcaggaggatgtcacgctgagaaagggagatgactaggagcagaaaaagtactctcactgttccagcttccagcccaatcctagcagaatgaatgcattttaaaaccagtccacattcacatgtgctgagaaggttgttagtggtccctcatctgggcaaagcagacccaaggtggtgctgagtgcagagtgcagagcattcttgtgctctcctctcatggctggaactatctgggctttgcgccctggtccagtgctacgtatcaaccccctcaacatgcctgtggctctgacacggggggatgaattaacttgcctctgttcaaatatacagacttggtgaggctgtcttttgttagtactgatgcacagggacagaaaaagcctgcaactttcagttgggagaatcctataaaagctgtgagcagcaataatttgcagtattgatcataggaagggaaaaaacattctctttcctattagagccccataacagaggtgacatctgtcccaaggccattccatggaaaatggtggctgctggcaattagtgaggctagtccagaagcaagcctccttctgatattggtcactgaaaacagctcactataaacggggtgttttgtggcattcaactctgttgtgctacaaatagagaatgcaaaaagacggtgaaagtaggagtgcataaatagtttttttcatgggtgccagacaggctaaggctttcatataaaaatattcctcactttcctcgtcctgtttaggaagcagtccagttggcataccacgaataggtcacacataggaaatggcctattttgaccaactggatttgtaattttccaaaccggattctgtccagcactgttctacactaatggaaattttcctcctcatgcccagccatctgaaccaaggacaggttccttctcctaagaggacagaggttggattccagaaaaaaatcctggagtcatgccaagagcagagtagcaaagctccctccatccattctccatgtcacgcagactgtattcctaatgaaaaacttcccccactcacacctgtgggatggagtggagcaaagcagttgacgaggaattgaggcaggcgctcctaagatggagggaggcggagagcagggctgtggaaaagaattttccatctgacctgctactttccatagctaatttatacaatattcacaaatcttaatggactttgagtcatttctagaaaagttggacagaaagagccaaagagcagcatgcgtttctctcctataaagacactttcactttcagtttcggaagtccaaatactgaggcacacaccaacggtggacagccctgcaggagcttcctgaaactatctacaattccaagtggatcaccagcttcagaattacacagggatcttatttgggataaagtgttaaaaagtgaatgacaggcttttttttttttttttttttttttctgaagtagaaagagagatagggcaagagagagaagagatggaaggagggggagaggccaaagggtcggcattcccttcatccagccgggccagaagtatgggccattctcaaaaagccactgctctttggagccactcgagaggttcacagtggctcccttctgaggcagtggcagtgggctcacagcagctacactggaaccacagtgcacatgtggggatgtgggcagcctcctggatcactcagggacagtgtggactcagggcccactccctgctggggctctggacgggccttactggtgcataggagagggaaatgataagaggaaatggcttctgactaggcctttccaagcgcatctcatgttttcagcttagatgatttgatagcaggtgttgtaatcctgagggggaaatgggtgacgaggaacactgctactcaaagccaagatggccttatcaaaggcatacaacatgagccttgtgggcactgcctcaccaaccactggtggctggttgtgctggttttacttggctcaagggctgctgggaaggtttgctgcgacaaaggcctgcatggcctacagagaaacccatccatccgcaggtgggggtgtggcttgaaagacctgctcttagttcccttctttaccctcctgcttgacatggagatgaggctccaggagagagagtgtaatggagttagtaagagaccctcatgaagtttcttgaggcaaacccgcaggctcatccactcctcttctctcggcagggggtagtgtcaaagtgctttggttgtcacaagacccagacacctaggttcccagtttggctggcccaagagttcttcatgaggcaaaagaagtggcagctggtgtcctaggtagagagcagccatacagacaccacatgtgttcctcctggctccacacagacgtcgtgtccagcaacagtctgatccttgcggtaagctatacaatgttctctgccccaggaaggggcccctgagggggtccacggtcctgcttactgtgcaactgggccagctgtagaactggcatgttgcacaggggacacactttacgaacctccagccacttaataaggcacctgcagaaggagacaccacagggggaagatgtcagtcctatgctcatggcacggctgttctgctgaacatctccatatctgtcacccagacaacgtctgctgtatggtccaaggagctcccctcctaggtggtgaacggatgtcaccccctggagagagggaagagacagagagaaggagtggggagaggccaaggggtcagcaatcccctcttccttccagagcctcccatcttccacgtgtgaagccacagatagtatgtgatactctcagttacccatgacttcttacaagaacaaaatacactgagcagggatgtgagaagtaggaaaataaatttttctaacagaaatacaaaacaaaaaattataagaggaagaatattaatatgtctgcaggaagtgggaggagagtgccccacactaccatttatatccagactttattttgattttaaataactatggttttgatttaaataagtttttaggagatgaggctctcagtggaaagttccagctaaatagctgtttattgcttgggctccaagtgtaggctcattttggctctctgcccatagtcctgacgtggtggtcacgttccaccactctgctgtctcctaatgtcacgcacacacacacacatcccacctgtagggtgctgtcagctttctgcattacagaccaatcatgaagccatcaagcttgtctggcactgccctaaaacccaaaagaagttggttgatgtgcctcaaactcgggtcccattaagtaattccataccaatacttactttctgtggaaggcgtgcttacatgggcaaatccccaactcatctcgaggcttgaagtcttctaggcacactgcacagagctgaaagacaaatgcacaaatgaagccaagtgtctgttaagtaccctcccaggtacaaagtagagtgcaggctcctaaaggctcaaccgtttgaagggactcatgagactcttatcttaaaaaaaaaagaaatgaatgaataaatgactgaaaagaaacaggccaaaatagatgaatgtctcctgctcttcctgtcccatatcttcaaggaggtgggcagatgggagaagacagaaagcaagaggcagctgcctttacttcagtgcatcagaagtgtgggaccgagggagggttactctcacatctgccagcttagcctgctgtccctttcctggtgtgccgaaagagctgaggctctctgggttctccaccttgtcagcagcacagcctggctcccaagcactcactgaaagggaccgctcaagccctggcaatcttttctcctgtttttatgcacagcttgcagtaacatgctatttatagttcctggggcctcccactttggcactgtccttctgtcagtgtctctgtcatataaaaagttactgaagactcagttaactcatgaacatgtgcagatgggaccaggactgctctcagccaatgactagtctccatggcttggagagaggcctttgccatcgtacccaggggctgggttccaacactttcctgggcattcaccagggcccgtggataccatgtgtcaccacactgacccattttaccgatgaggaaacagaagctcaggaaaataatgttgcttgaggccatttaattggagagtggccaggcctggctgggacccaggtctgttgcactgatgtgctgttgtgccattgctttctcctgcccagtggttgaactcctttctccctacttgcttccctgtccattcccaaggatcctggttcaggccatcaccatttctagcctggactgttgatggctttgctgttactagtttcttaacctataacacgtaacccagtcttcttagattatgtaacatgatccaggcaggacatgtggctcttggtgcccagtgaaccgtgccatgttggtttttaaacatccttgctgaggtagctttcagggccttgtgtgtatgacagacaggaccttcacaggaggagaatggataactgtgctctgttggactcagcatccctaccaagatggcaggggagcagggaggagagcaggacaggtggctggccttggctcagacacactagctgtgtggcctctgccctcaggattcctcacagagctctgttccttcatctgtacaataaggacatggcctgtcccaccctacacacggctgtcatcagctcagcttggggggtagggttaaggacacagtaaggcagtctaccaatgccagctgtttttattgatgtctacattttataatggaagtactgtttgcaagcccatttttgtcctctgaagggaggctgagaacaagctgtgggtaaaggtaaaaatccagcagtttcagcctagtggtatctttttgggcctcagcttcccacctgtaaagagggaatgatgctcccatctcctagactgtgtgattggccctctggccttcaacagccagttttcctctcagccccgccttccgacacagggtcaggactgtcctctggagatttagcactgatcctgttgaagcacaggttggatgagttgcttatttttattcacttatttttccaggatccaaaattagattagtagcctttccaaacaggagtttctttttttctttttgagatggagtcttgctctgtcgccaggctggagtgcagtggtgcgatctcagctcaccgcaacctccgcctcctgggttcaagtgagtctcctgcctcagactcccgaatagctgggactacaggtgcatgccaaccatacccggctaattttttatatttttagtagagacagggtttcaccatgttggccaagatgctctcgatctcttgaccttgtgatccgcctgactcagcctcccaaagtgttgggattacaggtgtgagccactgcgcccagccccaaaatggagttactattaatggtataatgtgctattatgttctgaataaacagatcctaaaactatagccacctgagaaaaaacaagacaaactctgacacgttaaatgctaaaggtgaccaaagtcaatggcaatcacaaaaagagaaaagcctcagatgacttcctagaagctccctaagagccaaactcattttacaactttcctttacagttcatattttgcaaataaacttttgtttccagtattcaatgagattgtttctccagtgtgacttcccatcaccattaaaaaactgagatacaattaatctactataatattcactcctttaagtaacagtacaattcagcagtttttaggtatatatgtgcagccatctttacaatctaattccagaacatttgcatcaaatgccacccacccaccccccaaaacaagcccatattcataggcagtcattccccattctcccctttccccaatctctggcaaccaaccactaatctactttctttattgatggatttgtctactcgggacatttcatataaatggaaccatacaatatgtaatatttcatgtttggcttctttcccttagcataatgtcttcaaggttcatctatattgtaacatatatcagtacttcactcattttcatggctgaataatattccactgtatgtatgtaccgcattttgtttacccatttatctattgatggccacctgggttgtttctaccttttggctattgtggacaatactgctataaacactggtgtacaagtatctggctgagtccttgtttacgttcttttgggtatgtatcaaggagtggaattgctgggtcatatggtaactctatgtttacctttttgaggagctaccaaaccgatttccaaagcggctgcaccattttacgttcctaccagcagtacgtatgggttgtaatttctccatatcatcaccaatacttattcttgtcttttttactatagttatcataatgggtgtaaatgggtcatttccttaatgactaatgatgccgtgcttattgaccaccacatatcttctttggagaaatgcctattaagtcctttgtcaatttattagttggtttctttttattattaagtggtaagagttctttatatattttagactgaactcccttatcagatagccaactaattttgacaaaggtgcaaaaagcatttcaatggcagaaggaaagccttttcaacaaatgatgttagagcactacacattcatagacacaaaagacacacgcagcctaagcagaaacacaacctaagcacaaccaaagcacaacctaagcaaagaaaccaaaggaaaaaatggataaactggacttgatcaaattaaaaaacttttgttctacaaaagaccctgttaggatgaaaagactgggagaaaatatttgcagacctttttattttgcaggcttcttattactgagttctaagagttctttatacatcttaaatacaagacccttatcagatataaaacttgtgaatactttgtccctgtgggttgccttcactttcaagataatgtcctttgaagcacaaaagtttttaattttttttttgagacagtcttgctctgtcacccaggctggagtgcactggtgccatcatagctcactgcagcctcaatctcctgatctcaagcaatcctccagctcctcaagcctcaacctcccaaatagctgggacttacaggcacacatcacgacacccaactaatttttttttttgtaagtagagataaggtctcctagctatgttgcccaggctggtctcaaactcctgagctcaagcaatcttctcgtcttggcctcccaacgtgttgggattacaggagtgagcctccatggctggcctgatgaagtttaactattttttcttagcttgcttgtgctttagatgtcatatctaagaatccattacccaatccacagctatgaagatttatacatctatgtttatttctcctttttgttttttagagacagagtcttgctatgttgcccaggctggtctcaaattcctggactcaagggagcttccccctcagccccctgaggagctgggattacaggcatgtgtcatggcactgggctcacctatgtttatgtctgagagttttataatattagctgatacatttaggtctttgattaacttttgagtaatctttgtatatagtatgaggtagatgtctaaatttattcttttgcatgtagatatccagttgtcccagcaccactgattgaaaagactattcttttcccactgaattgtcttggcacccttgttgaaaatcaactgaccataaatgtttgaatttatttttggacttgcagttctattccactgatctatatagctatcaatatacctgtgtcacatgtattaaaaactgtagctttgtatagtaagttttgaaattggaaagtgtgagttctctaactctgttcttctttttcaagattcttttggctattctggatcctttacatttccatgggaatttcagaattcatctgcttgtcaatttgtgcataaaagggcagataggattttgaaaaagatgatttggtaaatactttggatattactgccaacttaccaatattacattttctaaccaatgaacatgggatgtcatcccaattatttaggttttattatcttttcaacgttttatagttttcagcatataaatctgggcttcttttgttaaatttattcctaggtatcttatttttgatgctattacaaacgaaaaaaaaattttttttttgaggtggagtttcgcttttgttgcccacactggagtacaatggtgtgatctcagctcaccacaacctctgccttctgggttcaagtgatcctcctgcctcagcctcctgagtagctggggttacaggcatgcaccaccacacccagctaattttgtatttttagtagagacggggtttctctatgttgcccaggctggtcttgaactcctgggctcacgcaatccttccaccttggtctcccaaagtgttaagattatagctgtgagccaccatgtgcggctgaatgaaaattttagaactcaaacaacagaataatcacaataaaaaaacttaatggatgggctcaacagcagaatggaggggatagaggaaagaatcagtgaactagaagacagaacactggaaattactcagtctgaacaacagagaaaaaattactgaaaaaaaaaaaaactctccaggacttgtggaacaacaacaaagggtctaacatttgtgtcactggagttccaggagagagaaagagtgaaatgcagaaaaaacatttatagaaataatggctaaaaacttcccatgcttggcaaaaaaacctatatatttatgaagctgagtaaactgcaaacaggataaatccaaataaatccatgcctagacatatcataaattgctgaaaactaaagaaaaagaaaaaaatcttaaaagcagccagagaaagtgatacattactggtaagggatgaatgattcaagtgacctgatttctcatcagaaatcatggagggccagaaggaagaggcataaaaactgtcaacctggagttccatatacaagaatattcttcaggaatgaaggtgaaataaaaacattctcagatgaaggcaaactaacagaattcatagccagaagacctgctttaagaaaattactaaaggaaagttcattatgaagataaaagagaaatgacataagaaggaaacttgaaacaccgggaatgcatagcaacagaaatggtaaaaacctggattaatataaggctgttcctccgtgaaggttttcttatttttttgagaccaggcctcactctgtcacctacgcttgagtgcagtggcgcaatcaaggcttggctcactgtagcgtcgacctcccaggcttgggtgatctttccacttaaggctcctgagtagctgggactacaggtatgtgctacctgtaagtttttgtattttttgtagaaatggggttttgccatgttgcccaggctggtctcgatcttctggactccaggcagatgcctgccttttgagtttttaaaaacatgtctgatggggaaaagacatataatgatgggatttttcaatgtatatagacgtaatatgatagatattgcacaaagaggggaaggaaaagggatccatattgtggcaaggtctctacaatccaactagagtgttaaaaaactaattctaaatatttatttggtaatccctagagcaaccactaaaaaactatacaaagacataaagtaaaaatcacaacagataaattaaaatgaagtactaaaaaatgttctaataacccaaaagaaggcaagaaaaggaaaatagagaatgaaaaagagagagaaaagcagaagacaaaaaaaaatggtaaacctaattctaaatgtatcagcaattgcactgaatgtaaatgatctatacataccaattaaaagacatattggcagagtggataaagaaacatgacccaactatgctgtctacaagaaaactcacttcaaatataattcaatgggtagattgaaaataaaaagatgaagctgggcatggtggctcacgcctgtaatcccagcacctaagaggccgaggggggcagatcacctgaggtgaggagttcaagaccagcctggctaacatggtgaaaccccatctctactaaaaatacaaaaattagctgggcgtggtggtggacatctgtaatcccagctacttgggaggctgaggcaggagaattgcttgaacccaggaggcggaggttgcagtgagccaagattgtaccactgcactccagcctgggcagtagagctagactctatctcaaaaaagaaaaaaaaaaaagaaaagaaaaaggtggaaatacacataccatgcaaacaatcaaaaggaagctggaatggctatattaatatcagaaaaatatttttttttttttgaggtaggttcttgccctgtcacccaggctggagtacagtggcacaaccttggctcactgcagcctaaacctcctgggctcaagcaatcctcccacctcagcctcctaagtagctgggactatacatgtgtgccaccaggcccagttaattttttttttttttgcagagatgaggtctcactatgttgcccaggctgatcttggactcctgggctcaagcaatcctcccacctcagcctcccaaaaagttggaattacaagtgtgaaccaccgtgtccggcctggacaaatatatatattttttgagacggagtcttactctgtcacccaggctggagtgcagtggcgtgatctcagctcactgcaagctccgcctcccaggttcatgccattctcctgcctcagcctcctgagtagctgggactacaggcacccaccaccacgcccggctaatttttttgtatttttagtagagacggggtttcaccatgttagccaggatggtctcgatctcctgaccctgtgatccgcctgcctcggcctcccaaagtgctgggattacaggcgtgagccaccgcgcctggcctggacaaatatttcaaagcaaaggaatttacctgggatgaagacagtttttttttttttttgagatagtgtttcattcttgttgcccatgctggcgtgcaatggcacgatctcagctcactgcaacctctgcctccaggttcaagtgattctcctaccttagccttccgagtagctgggattacaggtgtccatcaccgcgcctggctcatttttgtatttttggtagagatggagtttcaccatgttggccaggctggtcttgaactcctgaccacaggtgatcctcctgccttggcctcccaaagtgctgggattataggtgtgagccacccagcccggcgagagaccttgacaaaagggtcagttcaccaagaagatattcaatgtgtatacaactaacaacagagcttcaaataaataaatagacataatgtattcacaggtcagaagactcaccatggtaaaggtcaattctctccaaacacatttatagagttaatgcaatataaatcaaaatcccagcaggattttttttttttttttgtggatacagatgagctgatgctacaatttacatggaagggtcaaggaaccagactagctaaaacaattttggaaaagaatgaggttggaagaatcacactgcctgattttaagatttactataaagctattaataatcaagacagtgtggtactgatgaagaaacaggcacacaaatcaagagaatataatggagaatccagaaatacagtcacaaaaaatatggctatttgatttttgaaaaaggtgcaaaagaatttcaatgaagaaagcaactcaccataaccaaagctggggatactatggtgaaaaaaatccaagactagatacaaatgaccagcgaaacaggaattggtgggtgtagttggatactaactatgatacatactgatgcaacacacaatgtatttattcaggacaaagtttctaaactaacaggtcacaccagtaaggaagacttctgttctggattaatctggtaaaaatttaatcttttcatttacggtcatcaaaaagactccaaatgggaaacagaccacttttattatttcatgttaattttggccatgtgtcaaaattaacttctaggaaaagtaaaaaatcaaacagtggccggctgccgtggctcacgcttgtaatcccagcactttgggaggccgaggtgggtggattacgtgaggtcaggagttcaagaccagcctggccaacatggtgaaaccccgtctctactaaaaatacaaaaattagctgggtgtggtggcgcatgcctataatcctagctactcgacaggctgaagcaggagaatcgcttgagcccaggaggcggagtttgtagtgagcggagattgcaccattgcactccagcctggatgacagagtaagaccccgtctcaaaaaaaaaaaaaaaaaaaaatcaaacagtaattaatgcttcagtttaatccaaggctaggtctaaaatgccattaaacagaaacatatcaattctttgatgaaaaatatgcagaaagagcaaaggaccaatagatgatttcaaaatatttaacaataatatgattatttttattatgattcaaaaaacctaacaaattaactttctttgaagagactggcaatttagcttcaccacagctaggctatatgcgacactgctattacaacacacagcttttcaagtccttgctttaaacaccaattagaaaacccagaaagggagaaggaaagggtgataaaaaataaaaattctgaaagtttgtagtcagaggcaacacaagaaatagaatgaaaaagaattcttataggctatgtatcttaatgtatacagcaggatatacacacccaagtttgtacttaagttacaaagcacctatgtcccaaccatgcaaccgaagagctaaacaatcccaaggattcatatcgctacctgtgtgttcttcccctgttccgtatgtcttaccttcttcaatccctacccccatgagataactgctctcttttttgtaccattggtaagaaagaaatattgggaacattttcaatggggaaattagtacatactcaccttgagtagaaaaactaacgtatctgtttcctattcatacagcatggacggcaagcagcatccctactgctatgaaattttataatggtgtcatcactattaaaagtatgagttatattactctcgtaaagccttcacacaattgatttttatgtgacctcaccctgaaatattctattaccccaatcaaaataagcctatttttttcaactactgagaataaaagtgtttaaacataccacagcataccactgctactagaaaatggctcaagaggatttacttatcatcaacttacctcatgtaaattcaattcttttactttctcttttaatataacctgtaagacaaaaaagtatgttcttatgcccatttaaatctgtaactttaaatatttctcattatattctcaaatatttttcttttgtatatatggctcatttccctcatattcaatattgaagggaatttcttttacagtttgagacagatcattttagcaacatttttttaacttgagcaatgatgcaatattctcctaaaaaaggaattttggccgagcatagtggctcacacctgtaatcccagcactttgggatgccaaggcgggtgggtcgcctgaggtcaggagtttgagaccagcctggtcaacatagtgaaaccctgtctctactaaaaatacaaaaattagctggatgtggtggcgcctgcctataatcccagctactcggcaggctgaggcaggagattcacttgaacccaggaggcggaagttgcagtgagccgagatcgtgccattgcactctagcctgggcaacaagagcgaaactccgtctcaaaaaaaaaaaaaaaaagtaagtcaatcttaattttgaaagttttgactccgtggtgaccagacagtagttaaaatgaatgccaagtgataagaaggaagtttactatttaagaaaaaactctgagactaaatatagcttattagagttatatttcatcttaaagtgaagaaaataggcaagtaaaatttgagggaaaatctctaaattttggtgtcttacattcctgaactaaaaatggatttgagggtaaatcctgttttcagaaatcacaccagaagctactataaggcctcacagggatatactaaatttcctatccagtatattttaaagatcaaatttactgtatgtcttgtgacttgtctagttttatcagtcaatttcacttaaatgactgcaaaggccaattttactttctagttagcctacatacaaatatcttgtaagctgtcaagattataatacgtggccaggcacggtagctcatgcctgcaatcccagcactttgggaggccgaggtgggcggactgcttgatcccaggagtttaagaccagcctaggcaacatggcaaaaccctgtctctacaaaaaatacaaaaattagccaggtgtggtggtgcacgcctgtaatccctgctacttgggaggctcacctgagcccaggaggcagaggttgcagtgagctgagattgcaccactgcactccagcctgcgtgacagaagcgagaccctgtctcaaaacaaaacaaaacaaaacaaaacagattatgataggagtctgggcaacatggggagaccccatctctacaaaaagtacaaaaattagccgggggtggtggtgtgcgcctgtagccccagctatgcatgccaccacactcagctaaggtgggaggatcacctgagcccagggaggtcaaggctgcagtgagctgtgatcatgccactgcactccagtctgggtgacagagaccccgtcaaaaaaaaaaaaaaaaaaagattatgataggactgagacaaaaagattcattcatttagaaaactaaaatactcaactctgattttggatcccacatgagacctgtaagagtgtggggttacctaaggacatcagtatgtccatctagggaatgtgccagtgagctcagatttcaaacatacatggacgaaagatgaacagaaagataagcagtcctggctgggcgcggtggctcacacctgtaatcctggcactttgggaggccgaggtgggtggatcacgaggtcaagagatcaagaccatcctggccaacatggtgaaatcctgtctctactaaaaatacaaaaattagctgggcgttgtggcagatagatggctgtcgtcccagctacttgggaggctgaggcaggagatcacttgaacccgggaggcggaggttgcattgagctgagatcttgccattgcactccagcctggcgacagagcgagactccgtctcaaaaacaaacaaaaacaagatacgcagttctgaagtgttacagttccataacatcagcgtcagcaaggttaaagactcaaataagctgaagctcccctgtacccaagaagaaagctaagggtaacaaaaattaagaatttcatgcttagagccaaaggaaaatctaggccccctgtttggaagaaaaaaataattttacttggcctttgagaaaagataagtgtattaacttaaagacaaaatcagtgaaggactaggtattgacagctatgatccaagtttgcagacttctagtggataatatgagctaacatttaaagtacaaaagggagtagatgagatcactgtaacacagctggtcgctcacctccgaggaactgctatgtcttctaataaagaaggaaggaaaaatttcacttaatggtatctcagaactccattaagtcgacagtaactttaagaattacaagctatagcatttctctttagcaatctgttggctcaagtttcctgttaaattatatcatctgaactttctacagcttcaagtaatgcttacaaaagaagagaaaagctgggcacagtggctcacgcctgtaatcccagcactttgggaggccgaggcgggcggatcacctgaggtccagagttcgagaccagcctgaccaacatggagaaaccccgtctctactaaaaatacaaaattagccaggcgtggtggcgcatgcctgtaatcccagctacttgggaggctgaggcaggagaatagcttgaacctggaaggcggaggttgctgtgagccgagatcacgccattgcactccagcctgggcaacaagagcgaaactccgtctcaaaaaaaaaaaaaagaagagaagaatacttaagaaaatgaagttgatatattatactgcaaattggcagtgagatgctaaaatgaacacaagtaaattcagtcccagtttaacgtatgagtggaaatcagagttctcagttttttggggggaaaaaaaaaatcaaagccaatctgaattaaatttctcacctgtttgtaggcataaaattctttgtgtgcttgatgtcttagcctaaaagacagaaattagtaatgcaatattgagatttccaacatagtaacttgaagaaaaataaaaagttgctgattttggtattaatttataacatttatggctcaaatgatataaattagaatctttaccctgaaatacacccaaatgatgtatctcttaacatgctatgtgaaagtgcccagggaaccatgaaatgttacccaaacgtaagatgactcaattctttttataccgacagtctacttatttcaataatatttatattttttcttaattagaaaaaatttaagtataacatacatccaatgaagtataaaaaccttaagtatacagctcaaaatcttaaaaaatgtacataccaggataactgttgctcatatcaagacatggtacatttccagcacacctgagccctctaaaatgatccttcctaatcaatatccatgccccagaggtagcactatcctgatttctaacactgtagattaattatgcctgtttttgaacttcatgtaaatggatcgtttggtatatactcttttgtgtttggtttctttcagtctacaatgccttgtgagattcttccatattgttgtagtaattgtctttctgactgacatacagtattccattgtatgaatataataccatttatttatccattttactgctgatgaatatttaattacttcctgtttgaggctattattaaagctgatacacaaattctacatgtcttttagtggacatatatactcatttctgttaagtatatacccgggagtagaactgctggttcaaagtactcacaccgaggctgggcaccgtggctcacgcctgtaatcctagcactttgggaggccgcggcaggcggatggcctgaggtcaagagtttgagaccagcctggtcaacagggagaaaccccgaatctactaaaaatacaaaaattagccaggcatagtggcacatgcctgtaatcccagctacttgggaggctgaggcaggagaatcacttgaacccaggaggcggaggttgcagtgagccgagatcatgccactgcactccagcctgggtgacatagtgagactttgtcttgaaaaaaataaaagtactcaccctggccggacacagtggctcatgcctgtaatcccagcactttgggaggctgaggcaggaggatcgcttgagcccaggagttcgagaccagcctggggcaataaggcaaaacctcatctgtacaaaaaatacaattagctgggcatggtggcgtgtggtcctgtggtcccagctactcgggaggctgaggtgggaggactgcttgagcctgggaggtgaaggctgcagtgagctgggattgtgccactgtactccagcctgggtgacggagtgagatcctgtcataaaaaaaaataaagtactcataacaattttacttctatgggtagtttatgagagttctaggtgttcacatctttgtaggttaagtctgaaaaatttttaaatttaaatgaagtctaatttatcaacttttcccaattaggttagttctttttatgtcccattaaagaaatctttgcctatcccaaaactatgaagatattctcctgagtatgttgtgaaaacaatttgttgttttacctaacaaatgtaggtctatgatccatctgaaattggtctttatgtatgctgtgaggtagctttttatcctcatatagactttcatttgcctcaccatcatttattgaaaagattctcccctttccccactgcactgcagtgacacatctgttgtaaatcaggtgtattgaatatgtcggtctatttctagagctgctattattctgctccattggtctatttgcctatccttgtatagtgatgaatgtgtccgcctcagctcccaattcatgtcaaactggaacctcagaatataaccttatttgaaaatagggtcttttcagattattagttagttaagatgaggttatattggattaagatgagccctaaattcaatttgactgctatccttataagaagaggagaggatatgcagagacagacggaaaagaaggccatgtgaacacagagacagagactgaagtgaggcagctacaagccaaggaatgccaaggctttctggtactcactggaagctaggaagaggcaagaaagactctctcctagagccttcagaggaagcatggctctgccagcactttacatttgaactcttctagccttcacaattgtaagaaattacattgctcttgttttaagttacccaatttgtggcactttgttacagcaacactaagcaaccaatgtaccttgtgtcaatatcatgctattttaaaaacttttattttgaaataattttagacagaaaagttgcaaaaaatagaattcacatatacctttctaccagctttcacatttatataaccatagttgtatatactatgtccacattttatacaaccatagtacaattatcaaaaccattaaattaacattgatatattagtattgatataacattgatatattattaactaaactacagaccttatttgaattttaccagttctttctctcatgtccttttcctgttctattatccaatccaggatcccatcttgcatctagttatgtctccttagccacttttaattttttgtttgttttttggagacagagtctcgctctgtagcccaggctggagtgcagtggcatgatctcggctcactgcaagctccgcctcctgggttcacaccattctcctgcctcagcctcccaagtagctgggactacaggcacccactaacatgcccggctaattttttttgtatttttagtagagataggatttcaccgtgttagccaggatggtctcaatctcctgacctcgttatccgcctgccttggcctcccaaagtgctgggattacaggcgtgagccaccgcaccaggccagccacctctaatttgttgagagttccttagtctttccttgtctttcaagattttgacatattaagtatgatcattctttcttggtggaatttgaagatttcaatttaagattggttaagatagtgtccactgggtttctccactgtagtgtatcttgagggagacacgctgaaattatacatatactctattattttctcaagcttttgcccactgattttagcatccaccttgcttgcaataattactgtagtgtttgcctaaactctaatggtggttttgtagttctctaattccttgcacatttattaactggaaatcttctataaggaagagatgtgcttcctcatttatttgtgcaattatttatttctatcagtctagactaatggacattggtcttaatctatgggaagagatgtgcttcttcatttatttgtgcaattatttatttctatcagtctagactcatggatattggttgtaatctatgagttacagttcaatatgatcactactttttgttgctcaaattgattggccttgagtccttcaggctgactcttgtgttctttcaacaagcccccatcctttcccatgcatttccgtatttactggcaccaaaagatgtttgtttcaggctcattttatatgttctgtgttccagccctggggttagccacttcttccaaggaaccctaattccttttattggagaaaagtatttagaacttgagatctgggtgcttggtgaacagcactttctcttaatactgttgctttaaaacaggttttggggtctggtagcaaaagtcctcaagttttattcttttgaatgactggcttggttattcttggttctctgcagttccatatagatttcaatttccaccagaaaaaaaaaaaaaccctcttggggttttgagtaagaatgtacaaaattcacagaccaactgaggaagaactgacatctttgcaagactgagtgtctaacctatgaacattatttctttatttacagctttaatttttctcttacacatttctcctagacatttggtaatttttgatgctactgtaaatagtgttgaaaaaaatctttattttctaattatttcttgctacctatatggaaaaaagtaatttttgtatattgatcctgtatctggtggcttgctaattctaaatagtttctctgtaaaaacttttggattttttaatgtacacaattatgttgtctgcatataatcacaatttaaacactgcctttataatctttatttgcttcttttctaaatacacttttcttttattcttttttcccgtttttttttttttgcactgactagctaggccctccagtatgatgctaaataaaagtgatagtgaatgtccctatcaatacatcactattaagtatgatgttttctttagatattttttgtagatactctttcaaattttagaaagttctcttgtagtactagtttaccaaaaaaaatcatgaataggtattaaattttatcaatgctttatgatattatactattaatgtgctatattgtattgattgcttttcaaatgttaaaataactctcgttcttggaacaaacctcatttggttgtaatattctaccttttttgtagatccctgaatttgatttacaatattttgctgatgaaaaggatcggtctataatttcctttctcataatatccttgtcaggctttgaaatcacaattatgctggcctcatgaaatgagctgagaagtatttgttccacttttattctctggaagtgtcatattggagtggtatttttttccttaaatgtttggatgagttacttggcttaaaatatcattgtgggaatgttttaaaaatacattcaattttcctttcttttcttttggagacggagtctcactctgtcacccagcgtggagtgcagtgcgtgatctcggctcactgcaagctccgcctcctgggttcacgccattctcctgcctcagcctcccgagtagctgggactacagacacccgccaccacgcccggctaattttttttgtagttttagtagagacgaggtttcaccatattagccaggatggtctccatctcctgaccttgtgatctgcctgcctcagcctcccaaagtgctgggattacagcatgagccaccgtgcctggcccaaaacacattctctctttttttttttttttgagacggagtcttgctctgttgcccaggctggaatgcagtggcgcaatctcagctcactgccacctccgcctcccaggttcaagcaagtcccctgcctcagcctcccatgtagctgggattacagacacatgccaccacgcccggctaatttctgtattttagtaaagatggggtttcaccatgttggccaagatggtctcgatctcctgacctcgtgatctgtctctttttcgtattagatatataattattcatattttcaatttcttgtagtagtttttttttttttttgagacagagtctcactctgtcgcccaggctggagtacagtggcacaatcttggctcactgcaacctccacctcccgggttcaggtgattctcttgtttcagcctcctgaatagctgagaatacaggtgtgtgccaccacgtccagctaatttttatatttttagtagagatggggtttcaccatgttggccaggctggtctcgaactcctgacctcaggtgatcccctgcctcagactcccaaagtgctgggattacaggagtgagccaccatgcccggccccggttttttctttttaaaaatttcattcttttatttttactcacattacaactaaccgccttcaagtatacaattcagtggtaagtagtgtactcacaatgttgtccatctaccagctatctctagtttcaaaatttttcatcactccaacaaaacacctggtaccccattcactgatcactccccattaccccttacttctatcccctgcaacctcttatctgctttttgtctctatagatttgcctattatggatatatcatataaaaggaacaatgcaatatatggccttttgtgtatggctttccacctagcatgtttttgaggttcatcctggttgtagtatgtatcagtacttcacttctttttatggctgaataatattccattgtatgtacatacaattatccattcatctgtcgatggacatttgggttgtttataccttttggctattatgaaacatttctgtacacgtttctgtgtggacatatattttcatttgtcttgggtatatacctaggaatgaaaatctgggtcacatggtttaatattttgaagaactggccaggtatggtggctcatgcctgtaatcccagcactttgggaggctgaggcaggtggatcatgaggtcaggagttcaagtctggccaacatagtgaaactccgtctctactaaaaatacaaaaaattagctgggtgtggtggcaggcgcctgtaatcccaactacttgggaggctgaggcaggagaattgcatgaacctgggaggcagagattgcagtgagccgagatcgcgccattgcactctagcccgggtgacagtgcgagactccatctcaagaaaaaaaaaaaagaatttgtttgaagatccaccaaactctttttcacagcagctgcatcattttgcatttctaccagcaatatatgcaagttcttatttctccacatcctcattaacacttgttatttttctgtttttgattacagcatcctagtaggtgtgaagtggtatctcattgtgtttttaatttggaattccttaatgaccaataatgtcaaacatcttttcatgtgcttgttggccatttgtgtaacttctttggagaattgtttaagtcttttgcccatttttaaattgggttgtctttttgctgttaaattttaagagcttttaatatattctgggtattaaacccttatcagataggacttgtaaatatttttctcccattctgtaggttgccttatcactttcttgatgtcctttgatgtacaaatgtttcgcatgttaatatccagcttcccagtaccattggttgaagaaacaattctttccccattgaatgatcttggcacccttatttgcatatcaatttgtcatagatgtttggatttatttctggactctcaattctattttattggtttatatgtctatctttataccagtaccacaattttttgattacagtagctttctgaagttttgaaatcaggaagtgtgagtccttctatttgtttttctttttcaaaactgctttggctatttggggccccagttccaaatgaatttgaggattgctttttctatttctgtaaaaaaaggccattagaattttgatagggattgcactgaatctgtagattgccttggaaaatattgacactgtaactatataaagacgatataaatccatgaacatggggtgcctttacatttatttaggtcttctttaatttctttcagcaatgttttgtagttttcagggtataagtctttcacttccctggttaactttattccttaaaattttattcttttggatgctattgtaaatgggattgtttcctttatttccttttcagattgttcattgttgatgcacagaaacacaactgatttttgtgtattgatcttagactctgaaagtttgctgaatttattagttccagtagttttttttgtgtgtgtgtggatcctacgggattttctctgtataggatcatatcatctgcaaatggagatagttacttctttctagttagatgccttctatttctttttcttgcctaattgttctggctagaacttccagtacaatgctgaacagtagtggtaaagtgggcattcttattgtgttctgatcttaggggaaagctttccgtctattaccagaaagtacaatgttaagttgtgtgtgtgtttttttttttttaataaatgccctttcttgtgtcagttttgatacacctctttttttgttaggaatctatgtaattcacccaaaatttcaagtttattgccataaatgcataatattctttgtgaccttttaatgtttataggatttgtaataatgtccctttttcattagtgatattagtaatttatattttagtaaattatattttataatgtatattttctttcctctttttcctgattagtttttctagagatttaacaattttattaattttccaaagaaccagctttggtctcaataatttttactattatacatttattttctagttcattgatatcgtgcttagcttttttactttcttccttttattttttcttgggtttaactggccttttattttagctccatgaaaacgttgctcattggttttagtctttcttgcctaatatatgaatttaaagctatagctttctcataagtttattaattatgtagttcaaataatctatatccttatagggtttttgcttgttttacattttatttctttacatgaaaaaataccattttcacataaagaaactattttcacctaaagaaataaaatggaccgggcatggtggcttatgcctgtaatcccagcactttgggaggctgaggtgggaggatcactcaagcccaggctgaggaacatagtgggactctgtctctacaaaaaattgaaaaattagctgggcatcagctgggctcagtggctcatgcttgtaaacccagtactttgggaggccgaggcgggtggatcatttgaggtcaggagttccagatcagatcagcctggccaacatggtgaaaccctgtctctactaaaaatacaaaaattagccaggcatggtggtacacgcctgtaatcccagctactcgggaggctgaggcaggagaattgcttgaacccatgaggcggaggttgcagtgagctgagatcatgccactgtactctagcctgggtgacagagcaagactgtctcaaaaaaagaaaaaaagttagccaggcatgatggcgtgtgcctatagtctcagctacttgagaggctgaggtaggattgcttgagcctgggaggttgaggctgcagtaagctatgatcatgacattgctctccagcctgggtgacaggctgagaccctgtctcaaaaaaaaaaaaataataataataaaaataaaaaataaataaaatgaattccattagaagtcattaaaatgaggctttatttgttaattcattttgcttgtttgaatcttttaattagatctgcatgttttcccaaaactgaacttgttacttccagctacagcatggatcaatttgtgctcacctttttcttccatctgtggctcaaaattcatcccttctagaaagttctcccttaaattaacttcattctatgaagttaatttgattcctccattactctaactcccattaattatctaatattttacattgcactattttattttgcactgctaaatagatatctaaaaagtatttaagaaggcatgattaacaatgctgaacagtgctagagaaatgataaaaccgtgtagcttatggccactgcaaatttgtggtctccagtctcagcctgattctccacattgctctctaatccttctatctattcatgctcagtatcctaagctttcatgcagtggttctttcaaacccttgccactctctttaagtgttaccctatcacttcctcccctataattttcaactgtcaattttttactacacaaataaagggggctgtgatgtatgcaagctttctcactcccagctccacatggctacaatatattttgttttctacagctaccctcatctctgtcttaggaaaaggtgttctcctgcttaggaataatattgctatctctcttatgtgtgtctcttttcacctctatgatttattctttcttataaatcttccacaattggctcattctccttaatatatgcatacacataccaaaatctctatcttacaaaaaaacccagcactaaaatacttccttgattctacagcaactcctcccctcaacctaatcttttccagccaaggttcttcaaagacagagttatattccttgtatccactttcacctactagccaggttttgccccattatagcctctaccatccctttccctatgctactgaaatttttctaccaaagattaaggatgcaaaaccttattgtcaaatgtaatgtgaacttttcaattgttatcctctttgttggcagctgacataattgactcaatccattgaaacactacttgtagggcatctttctcacaatattctgtgcccctgtgtgtgtttgttttgagatggagtctgctctgttgcccaggctggagtgcagtggcgcaatctcagctcaatgcaacctccaccttctgggttcaagcgattctcctgtctcagcctcctgagtagctgggattacaggcatgtgacaccacgcctggttaatttttatatttttaatagagatggggtttcaccatgttggccaggctggtctcaaactcctaacctcaggtgatccacctagctcggtctcccaaagtgctgggattataggcgtaagccaccattcccagcctcgattttcctcttatctcctgctatcccttctcagtctcttttaagggctcctcttaaatatcaatgtttccttaggattctgccctgggcccattttattttactatacacattctctctaggcaacactcctggcttcagcttctacctattaattacatgacctcctatttccagatcagacttctcacaagctttagagctacacatccaactaagtattaaacatcttcagacccccatctctgaaatggaatctatcatcttttcacttaaaatgtgcccattcattttctatctctcggaagggattgctatctacccagctgcctaagccagaagtccaagaaagattctaaaccccttctgtccttaatgtccagtcattaatttctgtttattttcacctcccaagtatttcttacaaccacaacatcttttctagatctactgtcattatcttggttcatgacctcataataactgtagccccaaaatttccctgtattcttcaaaatttatttttgagtattattaaaacataatacacaataattgtactatttatggggtacatgtaatattttgatacaagcatacaacgtataatgatcaaatcagggtaactggggtatgcatcacccctctattttttgtttataattttatccaagttacatatgttgtcatatgtggctctacagggttaataacaaaaaatcagcagtcctctgccctcttctcaagagataacccattttttccccctttagctcactattttgatcctgactttcatgtttctaaataacttgcctgtgttggtacttcttgattttttagttttaggcatatctaatgacttcctactagggaaccgttcattcattcacccagcaaatacttatcgagtgcttaatatcgtgccaggcacgattctgagtgtttgagatataacaaacacaacaaataaccatcagggaaaaaatatgaacaaacataaattagaatattatataattcattataaaacaggatctttcttagcaaggtaagatgcccttcttttgtgctccagtagtgccctgttcacagccctaccatagtcagcacattctatactacaatcctgtgtaagactgtggttggtagtgactgtcttgtttagacctaagttatagtcttcctatggttctgatgagtccagtggtggtgactggagggagctctctggagaacagaagaacctcctgggaaggtgctggagagcttaggttatcataaaaaatgagctagggtaattctggaggagctgactccacagatctctagattaactgcaaagacttgttaaatcccaatttaccatttgaagtgttaaaggtaacaaattaggatcatcacaaaggaaagctccttacctcatgattaaattttaaaaattggccaggcgcggtggctcatgcctgtaatcccagcactttgggaggctgaggcaggcggatcacaagatcaagagatctagaacatcctggccaacatggtgaaaccccatctctactaaaaatacaaaatttagctgggcgtggtggcgtgcgcctgtagtcccagctactcgggaggctgaggcaagagaatggcgtgaacctgggaggcagagcttgcagtgagccaagattgcaccactgcactccagcctggtgacagagcaagactctatctcaaaacaaaacaaaacaaaacaaaaaacaatcgtaccaatgactagtaaatgaagtttagaaatgtttgaacatttctgattaaacatgataattcaattttagtgtaacagatcctaatttctttgctttgttagcttatttttaaattttttaatttttatttttttgagacagggtagagtgtggcacaatcttggctcaatgcaacctctgcctccagggttcaagcgattctcatgcctcagcctcccgattagctgggactacaggcgtgtgccaccacacccaactaatttttgtatttttagtagagatggtgtttcacttgttggccaggctggtcttgaactcctgacctcaagtgatccgcctgccttggcctcccaaagtgctgagattacaggtatgagccactgcacccggcctgttaggctgattataaaaaaggataaggctgggtgtggtggctcatgcctataatttcagcattttgggaggcagagctgggaggactgcttgagcccaagagttggagaccagtctggaaaacatactgagacttcgtctctacaaaaaataaaaaaattagctgggtgtggtggtgggtgtctagagtcccagctactcaggaggctgagatgggaggatcacttgtgctaggaggttgaggctttggtgagcctcatgtcactgcactccagcctgggtgacagagtgagacactatcttgaaaaaaaaaaaaaagatacaaaaggataaaattaagtacatatcattattttttcattatcactttacttatttgcttgattattaaaaggaatacaatgaggtaaaagggtgtttcataacttacttttcaaaaactttgcccagaatcacaaattggtacattagtgggtttttgtttgtttaaagttaaaggcttacttaattctctgacatagtaatgaaaactatattatgagctatatattttagaattaaatattttacatatgataaccctcccttaataacattttcttttttttacattttgttatatttttatattttttgcctctttaaaaaataatttggttttgaatattaaatttacatatttctaagttaaatcaacattcgtagaggaattatcaaaaaaaactagtaagtctgaaaaaaaaaccatatttttatattctgaggtcctatatatgctatggctaattctctaattttaaaaaatgctgaatatttacataatgtttatcaaactattattaatttatatttgagtgctttattatattggaattgcagtaatattaacatttgtataaacacacaaaaccttgtcttttcttgctagaaagagatgtaaaaatctgaactagttgaacagtcttaactcattgtctagccagatgtggtggctcacccctgtaatcccagcactttgggaggttgaggcgggtggattgcttgaactcaggagtttcagaccagcctgggaaacattgcaaatccccatttctaccaaaaatacaaaaaaaattggccaggtgtggtggcaggcacctgtagtcccagctacttgggatgctgaggtgggaggatcacttgagcctaggaggaaagctgtagtgagcagagactgtgccactgcactccaacctaggtaacagagtgagaacccatctcaaataataataataataacaataaagaactcattgtccattggtaataataaatgtgtttacgatgcaacaaaaagtgtaacacaaaaatatattaaatgctgcagcaagtatttacatatatgtacctcatttttttttctttccactaaggaaggtgcttgtctacaaatagacaaacacaaatgctttggtgtttacaattacaaacaccccaagtctagaacttaaaagtggcagtactttttttgggacttcttcagttaacagttactttacacagtgctaaactttttactcttaattacatttttggatgatatttatatcccattgtcctagaacactgtgatcaaactatttttttttttttttgagacggagttttgttcttgttgtccaggctggactgcaatggcacgatcttggctcactgcaatctctccctcccgggttcaagggattctcctgccaagtagctgggattacaggtgcccaccaccacacctcgctaatttttgtatttttagtagagactgggtttcaccatgttggccaggctggtctcgaactcccgacctcaggtaatccgcccacctcagcctcccagtgttgggattttggacgtcagccactgcacctggctgatctaattattttaataatagtttaatagaaatgtcagaaaaaggaatttctggaaataaacaggttttataaaggttttttctgtagattacaattatatttgtctcaagtatttaattaatttggaggaagaaataaaagtcataagcagtcaacatatctatgagatataaggagcatcccctatgtttctttattattttattttttgagacagagtctcgctctgttgcctaggctggagtgcaatggcacgatcttggctcactgcaacctccacctcctgggttccagtgattttcctgcttcagcctcccaggtagctgggattacaggcatgagccaccacgcccagctaatttttgtatttttggtagagacggagttccaccatgttggccaggctggtcgagaactcccgaccttaggtgatccactcgcctgggcctcccaaagtgctgggattacaggcatgagccactgcgcccagccttccctacttttctgatacctaatgaccttagctaacaaggaagccacaccttgaaaagcaattttgaaatctctgtgagagtagattaaatcttggagatagacaatgacatacgtgtatctgtttaccaggtagaagggcagaaaaataaataaggacaattttctcctacagagtaaaacacttcatcagtagataagattgaagatcatataaaggtgttttactgattactaatgcacagattaaaacggtaagccatcttaattttttaaaaatttgccaattatcatacttcattttaaaaaaaatctgaggacagaaacttgattattgattatttaacatattttgaagtaacatagaatgaaaattggttacctaatcaagtagcaacagaagagtaaactaaggatgaagacaaatatagcagtaccaaaaaccacaatatatatgttgagaggcagattctggaatccaatattaggcatcctgaagttgtaatgtgggaaatccgagctcatggatgaactgtgggggaagaaaagaatggaaaaaaaataggtaaagactaagaaccaagacagcattatcattgtgcacgtatagaggcacaatgacctcatctgaaacaaatatggtagacaaagtgttaatattcttgccattcattcattcattcaccatgccaaatatttactgagtattatgtacctggcactatttcagagactggagatccaatataaaaagctttgcaagttgcatttattcactaaaaggcatttcactaaaataatgccagtaattaataaacatgaaaatgttcaacctcagagaagtgcaaaaagaaaaaaagttttaagattcttcaaactctttagcctttaacctaataactcaacccttgaagtaacaatatttataatggtaaaatattagaaataactgagatatctcacaaggaaatatgattaattatatagtcatatgttatagtattaaagggtcatgaaaacattttcaagtaattttttttttcttttgagacagggtctcattctgtcaccccaggctggagtgcaatggtgtgatctcagctctctgcagtcttaatctcccgggctcaagcaattcttccacttcagcctcccaaatagctaggactacaggcgcgtgccaccacacctagctaatttttaaaaatttttttgtagagatagcatgttgcctaggctggtcttgaactcgtgggctcaagcaatcatccctacttggcctcccaaagtgctggtattataggcatgagccactgtgcccggccaatttctccccattctatacacaaggaaactgaagcttagacagttctggtcccatggccatgactgacccggtatgtacacagccagagcctctccaactccaaactcagcagtctcagtccatatgctccactgccttgctcatgtgttacttttataatcagaaacagtaagtgttgtttaaacattaaaaaaaaggactatttctgtcagtttgtttgagaatacttactgattactacagttaaaattccacagataaaggatgcctctcctgtaagtgataagctgtagtttgtcattttgattccttacaaaataaagagttcctgccaggcctgcttattaagaccaaagattgacaatggaattataactatgaatactacaaatccaaacccaaacaaaactctaccaagcaaagaaaacttctacttttatttatgcatggtaaattaaaaatgtgttcacagatttttagttttcttgtaggttcccagaagagtatatttatactgttgacaccactgagatgctaactggctgtatctgaaatctaaatcttatgattagtttccagtctctagtaacatatatcaggaagtcagtacctgcaaagaacaacttcatcccatgtaaattcttctctgacagcttccaaacataaataatgggtaatatttaattttgaacctttggccattttctgggttggctcagttagagcaagtgcttttactcaaatacatatttaatttcctttttcctacattcagatcttcttacgaagggaaggaaggatgtagttaaggagtgctttaccaaatatacatagcacatacgctgtggagctattagaaaattacagggcacaaaactcagctcttaactttcatattgctgacagggcctcacttgatgacccttgttatagccaagacttagatggctgtcctttaatcccttagaaatatccctccccagacaagactggcttggtaaaatatctctcaccttagaaaataagggattaggccaggtgcagtggctcacacctgtaatcccagcactttgggaggctgaggtgggtggatcacctgaggttaggagttcgagaccagcctggccaacatggcgacaatgtgtctctactaaagatgcaaaaattaactgggcgtggtggcacacacttgtaatcccagctactcaggaggctaatgcaggggaatcgctcaaaccagggaggtggttggttgcagtgagccaagattgctccactgcactctacctgggtgacagagcgagattccatctcaaaaaaaaaaaaaaaaaaaaaaaaaagaagaaaataagagaataaacatctgtactgggcaagctaagaggaaataggcaagtgacagaaagtggtatggtagaaagacggagaggtttgcagtcagcaaagctggatgcttgctcccaggatgtcactagctaaatgtcagagcttggcccatctatacttcaattttctcatctttcaaatgggataatgggatattcaaatgggataatctaacaactttaaggaattcctgaaaggataaaatgagatagcagataatgaagtgtctgaaaactcaaagaggacaaaactattaaggctttagtgtgtgtgtgtgtgtgtgtgtgtgtgtgtgtgtgtgtttggggaaagggaatgacattaaatgaaagtagtaaataccataaaggaagccttgacaaaaatcatgtctctggagaggattccaccaaaccaagtgccccttccacagggagctcttctgcatgcactgacagctttctgtcaggtggcctgccaacctggcctccagatgcaggaactagaaaccatgtctggccaaaggcagccattaatacaggctagctaggagtgaggccagtggtgtgggaatgttgccctgcagagttcttgaaattggtacaattcttgtagcattctgtacaaagactcagacacacacagcagtagaggtagtagcactgtcatcagagggaagagacatctgccttagtgctgctgggggctggatgttgagacttttgtgagtcctcactacctggcagggccttttaataaatcccaattaccagagggatccaggctggtagaagatatgttgatgcgaatatattttaggaatttttctctctttgttttagtaaataaaatggcttcactacaattgatatgttggcccaacaattttaagtagatggtagagtattccaagatgttaatcctgatccagtgacacattagtttttacaaaatttttatcataatgtattttcaccagaagtattaatcttttaaaataaattgataaaaggctacatatcatcttagtaatatgcattctttgctattgaagtcttacaaatataagttatttagtaattgctccttgtgggagtgaagaggagaaatagaacatacagtacactgttgtagcttacttggcatttccaacttcattcacgtgaaagcctttttttccccttatgtaaattcagttcttgaaatctctagcctcagcctaaatttcaaaccacccagtcagtttattaaaatcaaaccaaaacaaaaaaaaaagacaagaagatttgagtattttatcagcaatcttagaaccaagaagttctaagagggacagattacttgagatttggatgcctacatgacctgagtttaacacaatacaccacagctaaatggggctgcagtagcattcctcaaagcatgcttggtagccacattcttcttagaccagttcctgttccctggacaataccatatcatcttcccaggagtcaatattctagttttgcttcaaaaatgctcagaagtgccgggtgcagtggctcatgcctgtaatcccagcactttgggaggctgaggcgggcagatcacgaggtcaggagatcgagaccatcttggccaatatggtgaaactctgtctctataaaaatacaaaaattagctgagcgtggtgacgcatgcctgtaatcccagctactcgggaggctgaggcaggagaatcccttgaaccatggagtcggaagttgcagtgagccgagattgcgccactgcactccagcctggcaacaaaaaaaaaaaaaaaaaaaaaagaaagaaagaataaaaaatgtaacaggtggctgggtgcggtggctcacgcctgtaatcccagcactttgggaggcccaggtgggcagatcacgaggtcaggagttcgagacctgcctggctaatgtggtgaaaccccgtctctactaaaaaatacaaaaattagatgggcctggtggcgtgcgcctgtaatcccagcttctcaggaagctgaggcagattagcttcaacctgggaggcagaggttgcagtgagctgagatcgcaccattgcactccagcctgggacagagcaagactccatctcaaaggaaaaaaaaaatgctcagaaaggggctgggtgcagtggtacatgcctgtaaccccagtactttgggaggctgaggtgggaggactgctcgaggccagggatttgagaccagcctgggagacacagggagaccccacctgtacaaataaaaataaaaattaaaaaattagttgggcatggtggcatgtgcttgtagtactagttactctggaggctaagatgggaggatcacttgagcccaggaattcaaggttacagtgagctatgatatcactgctacgctccagcctgggtgacaaagcaagactatctctaaaagagaaagcttttgacatattagaaggaactaacttctttgttatttattgagtatctttatgaccacatgaaacaccttctgcaaaatcttttcttgagtgggtggatgagaggaaagattaaaaattttaaaaacatgtcactgatcagtagaaagacctaagctttctgatgaaatggatacactgggttctagagagaattattttaaaaataagacctatatttggacagatcctagtaaaatttctgaattctaggatagaaaaactgtgataagtttccaaaaaaaaaaagttgttataatggaaagcatatagatttgagatttatcctaggccatgagtattagagtgggcttatggagtcagagagccaggggtttaaccacggatttgtcagtaatttggggcttgtttcttatcttttctatgtctcggtttcctcatctgataagacagaataatactagtaactatttcataaagttttaagggaattaaatgactcaacacacgaaaagcacttaaagcacttagaacagtacctgggcacatactgtgtacttgagaaatgttagttttcattattaactaaaatgcaacaataaaagataatggaatcactgtctgtatctccattaaaagacagtcaggtagacttctgactccagaaagatggcatagacatacatttccctatttatccagctaaatataactaaaaaccatggacattaagttggacagaaggtagcacactaactagggacctggggacccaaggaaccacatgttaacgagttctctgggctttgtttttgtctcctatatcccagacttagagctggcaaagttggcaaacaagaatgtcaacaggtgaagacaaaaaaaaaaaaaagccctaatgaacgtgttctctctagccaaaggatgacaaaaggagtagttaacaagactgaaagcttttaaacaagaattgccctacttcagctaaacaacccagaaaaaactatggccacacccctatagacatgccagcaaaggctgaaggcagagcctagattttcactcttgccaggatgtaacgagatgccccccagccatcttgctgggatagtgttagaaaaggccaagtaggaagctgaaatctgttttttttttttttttgagatggcgtcttgctctgtcaccaggctggagtgcagtggtgtgatcttggctcactgcaacctccgccttccaggttcaagcgattgtcctgcctcagcctcccgagtagctgggactacaggcgcccaccaccatgcccagctaatttttgtatttttagtagagacagagtttcaccatgttggccagctggaatttttacacaacatggtgaaaatgaggctccacctcagtgatatcagtagagactacatgtggaccctgacttctacccctatccagcagtaacaaagtgactatactcctcctcaatggggtgatgacagaggaggatctcgtgaagaatcgggattttaccaccaccaagtggcaacaagcactcctaccttttccagccaaagaggtatcagtgaaagcctagttgagagctggaactcccattcctgccccgtccccgccccccatgtcaataaaggctaaatagggaacctggacttctacctttacctggcattaatgaagcagcattacaacccaccgtttcactgtcagagtgctgtcaaaggaagccagttaacacatcaggtttaaaaaaaatccagagtctcataacataatacacaaaatgtccaggtttcaactaaaaattactcatcgtaccaagactaggaagatcacaaatcaaatgagaaatgataattaacagatgctaatgtcaatgacaaaaatgttaaaattatctgacaaagattttaaagtagccgtcatcaaattgtttaagcaagcatttatgaacatgcttgaaacaagtgaaaacactgaaattctcagcaaagaaacagaagatataaagaggaacaaaatggaaattatagaactgaaaaacacaataattgaaataaaaaaactaaaactaagcgatgggctcaacagcagaatggagaagaaaggggaaagcataagtgaactagggccaggcacggtgactcacacctgtaatcccagcactttgggaggccaaggtggatggatctcttcaggtcaggagttcgagacaagcctggcaaacatggtgaaaccctgtctctactaaaaatacaaaaattatccaggcatggtggtgggcacctgtaatcccagctactcggcaagctgaggaatctgtacataagtgtacagatttaagaagctgaacaaactccaaagagaataaacccaaagaaatctacaacaagacacatcgtagtcaaacttctgaaaactaaaacaacaacaacaaaatctttttttttctttgcagaggtaattgagttaaaacaacactaaaaaatcttgaaagcaactaaggagataccattgggggaaataatatgaaagacacagatttctcatcagaaacaatggaggccaaaaggaaggaacacatttttcaagtgctgaaagaaaagagccatcaacccaaaatcctacatccagcaaaaatacccttcaggaatgaaacaggaaatcaagacagcctcacatgaaggaaaacaacgggaatttattgctagcagacctactcttgaagagtgactaaaggaagctgtcttaacagaagggaaatgataagaaaaggaaccttggaacatcaagaaggaagaaacaacatggtaaacaaatataagggtaaatacaataaacttccttctcttgagttttctaaattatattcagtggttgaagaaaaattataattgtccaacccggttctaaatgtattcagaggaaatatttaagatgagcatattaaaaataagggaggataaagggacataaaaggaggtaacatttctagtctgaactggtaaagtatactagtagactgcatatataatacaatgcctacagcaatcagtaagaaaactatacaaagacatacactcaaaacactacaaaaaatcaaaaaggacttcaaaaaattactcaagtaacagaaacaaaaatagtgaaaacaaatagaaaacaaagtttaaaatggcaagcttaagtataaatgatttaaatatgccaattaaaacacagagactggcagaatgaattaaaaaacatcacccaataatatgctgtctacctgaaactcactttaaaaataatgatacatgcatgttgaaaaggatggaaaaagatatgtaatgcaagcattaatcaaaagaaagcaggagtggctatattaacatcaaagcagatttcacagaaaataaaattaccagagagagaaagaaacattacctaatgataaaatggtcaacccactaaaaatacatagcaatcctaaatgtgcatgcacaaaacaacagagctgcaaaacatgtgaaggaaaaactgactgaactgaaaggagatataaagaaatctataattatactcaaatacttcaaaaccttctcccaacagctgatgaaacaactagatagaaaaccagcaaggataaagaaaaattcaacaacacaattagacaacaggatctactcaaaatatatagagcactctacctagcaacagcaaaatatacattcttttcaaatacccatggcacctacaccaggacagaccacattcctggtcataaaacaaatctcaaacaacctttcaaaaatcgaagtcatatagagtgtgttactggacatagttgaatcaaactagacatttataacagaagggtagcaagaaaatatccaaacacttagaaactaatcaacacactactaaataatctataagtcaaaaagaggtcttaaaagaaatttttaaaaatacactgaattgattgaaaatgaaaatacaggctgggtgtggtggctaacgcttataatcccagcactgtggagggccgaggcgggcagatcacctgaggtcaggagttcaagaccagactggccaacatggtgaaaccccatctctactaaaaatacaaaaaaattagtcgggcgtggtggcacgcacctgtagtcccagttactcaagaggctaaggcacgaggatcgcttgaatcctggcggcggagattgcagtgagccgagatcgcgccactgcactccaacgtgggcgacagagtgagactccgtctcagtttaaaaaaaaaaaagggctggacgggatggctcacgcctgtaatctcagcactttgggaggccgaggcgggtggatcacatgaggttaggagtttgagaccagcctagccaactaggtaaaaccccgtctctactaaaaacacaaaaattagctgggtgtggtggcaggtgcctgtaatcccagctactcgggaggctgaggcaggagaattgactgaacccgggaggtggaggttgcagtgagctgagattgtgccactgcactccagcctgggtgacacacgcgaaacgccatctcaaaataaaaaaaaaagaaaatgaaaatacaacatatcaaaatttgagagacataggtaaagtagtgctgagtgggcaattcatggtactaaacgcacacataagaaaataaaaaatctcaaatcaataatctaaactcctacatcaagaacccagaaaaagggcaagttaaaaattaaagaacagaaaccagttaaattgagaataggaaaacaatagagaaaaatcaatgaaacaaaaagctgagtcttttctttgaaatgatcagtaacactgacaaatctctaggaagaatgacaaaaaaaaaaaaaaaaaaaaaaaaagagaagacacaaattacctatatcaacaattaaataggagagatcactacagacactgcagacatcaaaaggataagaagggtatacacacatatacagacataaatttagtaacataaataaaacagaccaattcctcaaaaaacacaaactacaaaaactcacccaatataaaatagataatgtgaacagttttataactatcaaagaaactgaattagtcatttaaaaattcacaaaaaagaaagctccaggccaagaggcttttaccagagaattctaccaaaagtttaaataagaatgagcacaaatccttgacaatcttttgcagagaatgggagggaacatttctcaaggcattttttgaagccaatgcgaccttgatagcaaaaccagataaagacagtgtctggcaaatacagacagaaaaattcttaacaaaatattagcaagtagaatttggcaatatgtaaatagaattttacaacaccatgaccaagtaaggtttattcaagagatgcggggctggcttaatattaaaaaaaaaaaaaatcaatgtaatctatccatattaaatggctaaagaagaaaaatcacatgatcatattaactgatttaaaaaaaacacatttcacaaacatcagcacccagaaattaaaaaactcccagaaatagaaatggaagagaacttcttcaacatgttaaaaagcatctacaaaaaacaaaccggcaaaaaccaaccaaacaataacaacaaaaactgtacagctaatattattcttaattgtgaaagactgaatacttacccccctaagaccgggaacaaggcaggatatctgctctcaccactcttattcaacatagtgctggaagttctagccagtgcaataaggtagaaaagggaataaaaggcatacacatcagaaaggaagaaattaaactgagcctatttgccacatcaacatctacaacaacaaaatcccaaagaatcttcaaaaaaatttctaaaactaataaatgagttcagcaaggttgcaggataccagatatacatataaaaatcaactgtgtttttataaattagcaatgaacataggaacactgaaattataaatacaatgacatttacaattgttcaaaaaaagaaatacaaagaattaaatttaataagacattagatatgtacaggacttatatgctaaaaatgacaaaatgatgattagaggaatcaagtaaaatctaaataaatgcagagacatactatgttcatggatttgaagactcagcataggaaagatattctctccaaattgatatataggtttaacataattcctataaaaatcccagcaaattttttttttgtagatatagacaagtttaacaaatgtagacagaaagaaagacaaggaaataaaacagctaaagcaattttgaaaaaagaagactaaagggagaggaatcagtctattcaatgtaaggactcatcatagcctaatcaagacactgattggttttagcaaaaggatagacacataagtcaatggaacaaaatgaagaacccagaaatagacccacacaaataagcataaatgatttttgagaaatgtgcaatcctttctcaatggagagagtatatggtcttttcaacaattagtgctggaccaatgggacatccataggcaaaaaaattgaatcttgatcttaacctcacacacaaaaaaacaactcaaagtggatcatgaacttaaacttaaaatgcagaacaatgatacagttacaaaaaacctaagagaagatatttgggatctaggattaggtaaaaagctccagacttgacaccaaaagcaaggagtataaaaggaaaaattgatacactggacttcattgaaatgaaatgttttttttgctttgaaaaactgtcaagaggatgaagaaagaagctaaagactaggaaaaaaatatttgcaaaccgtatgcctgataaagggctaatatctaaacacaaaattcaatagtaaaaaaacaaccagttatgggttgaattgtgttctcaaaaagatatggtgaagatataactcccagtacctctgaatgtgactttatttgaaaataggtttgttgaagatgtaattaattcagatgtaattaagaagttaaagttatactagagtaatccaatatgactggtgtctttataagaggaaaagagacacacagagagagatacaggaggagagaatgctgagtgatataagaagcagagactgaaggattgctggctgtcatcagaagagaggcatgaacaaatcctttctcagagccctcagaaggaacaaccttgctatttttttttttgcaagtgattctcctgcctcagcctccctagtagctgggactataggagtgcaccaccatgctctgttcatctttgcatttttagtagagatggggtttcaccgtgttggtcaggctggtcttgaactcctggactcaagtgatctgcccaccttggcttcccaaagtgttgggattacatgtgtgagccactatgcctggccaccaacatcttgatttcagacttctaaaccccagaattgtgagacaatagattttctgttgttttaaggcacccagtttatggcacgttgttaaggcagccctaggaaacaattcaattagaaaatgggcaaaagagatatttcaccaaagggaatatacagatggtaaataagtacataaacgtatgttcaaaatcattagctattagggaaatagaaattaaagccacaatgagaaattactaaattaaacctatcagaattgctaaaataaaaaattgtaacaacaccaaatgctggcaagaatgcagagaaactagagcactttatcttgttggtgggaatataatatggtatagccactctggaaaatagtttgtcagtttcttgtaaaattaaacatgcaactgccatacaactcagcagttgcactcctgggcatttattccagggaaatgaaaacctatgttcacatacaaacctcaacacaaatgttcatagcagctttatctgtaatggtctaaaattagaaacaacccaaatatcattcaatgggtgaacgattaaacaaacttgaggtatgcacatcgtcaaatgccactcagcaataaaaagaaacaaactattgatagatgcaataatcagagtcactttccagataattatggtgaatgaaaaaagccaatcccaggttacatactgtataagtacacttatcttgatgtactgtaagaaatccctgatgtgatggaaaccttctgtatgttgactgtatcaaagttaatatcctggttatgatattatactatagttttacaagatgttatcattacaggaaattgtgaaaagagtacataggatctttctgtactgtttattgtagctgcatgtgagtctataattaaaataaaaattttaattaaaaaatatacaatggagcaacatctatacaggtctgatggaaaagaactgtgatattagaactgtatatccagccaaactatctttcatttgtatagaaaaaaaagaaagaaggaaaaagacattttcagacattcaagtacatttctttctctttatataggtacgtaatcattccactaattaaaatcccccatagtaatctagattaaggcttcaggttatttcagcaaagcatggaagatggaacggggagaagaaagttaagttgtgctaatagttttattttgaaaagctataactacttaatttaaaaagttgttacagaagtataagtctaaatacgtgttttaaaatgtagggagccacaaacagtatgtataattttcatgactagcagagaggaaaaagcagcaaagaaacctggataatttcagcaaaatatagggtaaaaaggggaagaaggggggtcataagaaagcaaattatagaaatataaaataaaatggtaggaacaaaacgaaaaataaatcatgagaaaaataaatggtttaaatcctatttaaaaaggctctaggccaggcatggtggctcacgcctgtaatcccaggactttgggaggccgaggcgggcggatcacgaggtcaggagatcgagaccatcctggctaacacggtgaaaccccgtgtctactaaaaatacaaaaaattagccggatgtggtggtgggcgcctgtagtcctagccactcgggaggctgaggcaggagaatggcatgaacccagaggcagagcttgcagcgagcagagattgcgccactgcactccagcctgggcgacacagcgagactccgtctcaaaaaaaaaaaaaaaaaagggctctagcttccacgatttggcacacacacaaaaaaccccagaaagactctaggatgaggagaagctggttaacacgtacaaaaatacagttagacacaaagaataagttctagtattttacagtgcaatagggaaactgtagttaatactttgttgtattccaaacactacgaaatgaagaaaactaatttttttttttttttgagatggagtctcactctctcgcccaggctagagtgcagtggcgtgatctcggctcactgcaacctcagcatcctgagtagctgggattacaggtgtgtgccaccatacccggctaatttttgtatttttagtagagacggggtttcgccctgttggccaggccggtcttgaagtcctgacattgtgatccgcccaccttggcctcccaaagtgctggaattacagacatgagccaccacgcccagccaagaaaactaaattttaaaagtaaaaaaaaattaatgtatatttcaaaatagctagaagagaagaatttgcaatattcccaacagagaaaaatatttgagctgatatctcaattaccatgatttaatcattatacattgtacacatataccaaaatatcatgtgcccccaaaatatgtacagctatgctttaatcaaaaaagactctaaaattatataagaacaatattcagctttattataagaaaacactttaaatgattctaagatatttttaaatgcgggatgcaataagaaaataaacaaaaatatagcaggcaagtataagaaagcaagcaggagtgctaattatttttaaaaaaagtagaaataaaggctaaaaagctatatgaacaatgatgttttatagtgatagaaatattaatctccaaatgagatataacaaaaaagaggacataaacaataccattaacaaataatatatatattggctgggtgtggtggctcatgcctgtaatcccagcactttgggaggccgaggtgggtggatcacctgaggtcaggagttcaagatcagtctggccaacatggtgaaaccccatctctactaaaaatacaaacattagccaggcgcggtggcgtgcgcctgtaatcccagctgaggcaggagaaacggttaaactcggaaggcggagggtgcagtgagccaagatcgcgccactgcactcaagcctaggcaaaagagtgagactctgtcaaaaaaaaaaaaaaacccaaaacaaataatatatatatattatatatctacgtatctatactgtgtgtgcgtgtgtgtgtataactttgtgtcttaacaaagaaaacaccttttcatatgaatctggaacatctacatttagataaactatttatcatgctataggaagattccacagaacagaactcttagaggccacaatacgtgactacaatgtgtaaaattaactcaacaataaaaagataaacaaaaggaaactacttataaattcaaaaaataatctttaaaatgacttcaggccaggtgtggtggctcacagctgtaatctcagcacagcactttgggaggccaaggtgggtggatcacctgaggtcaggagttcagaccagcacggccaacatggtgaaaccccgtctctactaaaaatacaaaaattagccgggtgtggtggtgggtgcctgtaatctcagctactcaggaggctgaggcaggagaatcccttgaacccaggaagcagaggttgcagtgagcagagattacgccattgcactccaacctaggtgacaagagtgaaactccacctcaaaaaaataaataaaataaaataaaataaaatgacttctgtctagtaagtaactaaaacaaatcacagaccatttagaagttaatcacattgtgggaaaaaaatctcatactgagagaaaaatccattaccttcaacatgggaaaagtattcttacaggctactgtgtaggtgtataagtgtaactgatcgtattatcaatctaaaaaagaataatgaaaataaatggacacaagaattcaattctggaaagtagaaaaagaacaaatcaaacaaaataagccagaagaaggaattaataaaggtcaaacaaaaatgtatgaattaaaacaaaacaatgaaaggaattgaaatcaactaaccaaaacactaagaatgagacagataaaaaaattcttatgcagagatttaaaaacatccatgagataatttgagtattaattttaaattctagaatagattttataggaatataaccaaaactggctcaagaagaaaacttgaaaatatagaaatatcttcacaaaaaaggcttcagaccccaatggcaatgaaagtggaactcgctaaacttgcatagataagtagtctgctatgtacagtagtccctgcttatcgatggtagatatgttcacagacccccactggatgcctgaaaacccggatagcaccgagtcctacgtttttttgaactgataaccaagaccctaatgggcaggtagtgtacacagcatgcagacactgggcaggggatgattcacgtcctgggtgagatgcagtgagcacgacagcttgagatttcattacactactcagaatggtgaataatcgaaaacttacaaattgttttgggaattttccatttaatattttcagactacagttgaccatgagtaactgaaactgcagaaagcgaaactgaaaataagggcgaactactgtaaactgattcagagtatacaaaaaaatgatggaaagcatcccaactcatttaaaggtgtaagcataatcctgaaactaaaaccacaactttacagcagagttcataaactcaaggcctctggactgaatctggcctgaacaagtattttgtttggcctgtacaaaattttaaagattgagataatttagatttgggagatttaacataaaattagcaatttccagctctatacagaaaaaggtcagatctaataaccctgggctccattcttacacggcaaaaacagcctggagctgagtggcctctgctcccaggctgccatgttgttgcacaatttgtgtgtgtgtgttggggggggcagggggagggggcggccctgaatgcttatgggttacagtgtaagtgtgcctggccctattgtcaacagaatcgccatttgtcaccatttctaccactccttatcacttcctaattctggaccagatgtaggttgccacttgtgcttgggctgttatttttctcaacgtaaatatttctacctctatcaaaaaaaataaaagaaaagaaattgatggtttcatgattttgccttctaccaagtgtatttggctgattcaatttcctgcctggcttctgttggcactgagtttgtgcccctgctttacgatttctatctttggtttccccacatcagatgacagaaatacccacttatattctcttttatttgcatagttttatgccttaaatttaaatgtttaatccatcttgaatttatggcatggaaaaaagacctaaaatggtttttccaatttagtcaactattccaacagcatttataaaattctttctccactgtcttaaagttctaccttttttggagtcactttttttcttttttttttttgagacagagtctcgctctgtctccaggctggagtgcagtggcaccatctcggctgactgcaacctccacctcccaggttcaatcaatactcctgcctcagcctcccgagtagctgggactacaggcatgcaccatcatgcccagctaattttttaatatttttacatacatacattacatatgaattagcataccactaattcatatatgctagggcaatattttcaacactactcttcctctttaatattttcaaggctattcttacataatctttttttcagctaaaccagtctttaaaatattctattgggccgggcacactaactcacgcctgtaatcccagcacttggggaggcagagatgggcagatcacttgagctcaggagttcaagatcagcctggacaacaggtaaaaccccgtctctacgaaaaatataaaaattagctgggtatggtggtgcatgcctatggtcccagcgacttagtagggtgaggtgggaggatcacctgagcccaggagcagtgagcgctaatcgcaccactgcactccagcctgggcaacagggtgagacctcgtctctctctctctctctctctctctctctctcaataaataaataaataaatgctattgtgaagttaattgaaagtacattaaatttatagcttattttggggagaatgggtcttgctatggtttgagtatctgtcccctcccaaactcctcttgaaacctaataacaattttaacagtattaagaggtagagggttgggcgcagtggctcatgtctgtaatcccagcactttgggaggccgaggcgggcagatcatgaggtcaggagttcgaaagcagcctggccaacatggtgaaaccctgtctctactaaagatacaaaaaattagccgggcctggtggtgcgtgcctgtaatcccagctactcgggaggttgaggcaggagaatcgcctgaacccaggaggtggaggttgcagtgagccgagatcgtgccattttgcactctagcctaggcaacagggtgagactctgtctcaaaaaaaaaaaaaaaaaagaggtgggagcctgctgcagtggctcacacctataatcccagcactttgggaggccaaggtgggaggatcccttgagcccaagagtccctgactagcctgggcaacatagggagaccctgtctctacaaaattaaaaaaatcagtagccaggtgtggcgacacatgcctgtggtcccagctacttgggatgttgaggtggaaggactgcttaggcccgggaagtcaaggctgcaatgagctgtgattgtgccaatgtattccatccaccctacatgacagagtgagaccctgtctctacaaacaaagtgagacctttaataggtgattaggctatgagggatctatcttcatgaatggattaatgccattaccaaggaagtgggttccttataaaaggaagagttcagaccccttttgtgtttgtttctctctgtctttccccttctgcaatgtgatgccctccaccatgttatgatgcagcaggtaccttgccagatgccagtatcttgatcttgaacttcttggcttctagaactgtgagaaacaaattcctgttcattataaatttctcagtctgtagtattctattatggcagcacaaatggactaagggaggtctttacatccaggcacgtggtatgtcttttcatttattctagttttattttactactttcagtagatttgtatagcttattcatacaggttttggacttttctttagtttatccctagttaccatatatatatttgcctatacgtattataaatggggtcttttttcctttatattttttaaactggttatttctagcatttaaaaaagctacttctttgtatatttattttgcagcctaacctagaaaaaattttagtgcaggtgcaactaactgccatataaataaatcttaataaagcacccacagaatacccagcttggagcagtgagcactccaagaaaaactagctgcaaaatatacactaagacaactaaacacagtgactttctgtgtaatctttttatttatatatcacctaaaataattataaaaatacatatcagccaggcgtcgtggctcacacctgtaatcccagcactttgggaggccgaggcgggcagatcacctgaggtcagatgtttgagaccagcctagccaacatggtgaaaccctatctctattaaaaatacaaaaattagctgggcatggtgatgtgcacctgtagtcccaactacttgggaggctgaggcaggagaatcacttgaacccaggaggtggaggctgcagtgagccgagatcgcgccactgcactccagcctgggtgacagagtgagacttggtctcaaaaaaaaaaaaaaaaaaaaaaaaacaagtgaaaaagtctgggcacagtggctcatgccagtaatcccagtgctttgggaggctagggtaggaggacaacttgagcctgggagtttgaaaccaggctgagcaatatagcaatacccaggcaaggtggggtacacctgtagtcctagctactcaggaggctgaggtgggaagactgcttgagcccaggaattggagtctgcggtgagctatgaccagatcataccactgcactccagtttcggtaacagagctagaccctgtctcttaaaaaaaaaaaagaaaagaaaagaaagcttttggcaaattagaagtaattcacttcttcattgagtacctttatggcctcttgtgagcttcggttatcaagattttcccaggacctagtcatccctggcaaggctgcatttctggatatttgaggaccagacactgtaatgcagcacctccggtggatatcctgcactgagaggttttgagcctcagcacctaagctggccctcctgaatgataccactgcctcacttcctttaaggtgctctagtctctacaacttatatttcaaaggtctccctctgtattcccagtcttttatgatattttataatctgtaaacttaattatttgaaatagacatcagggttccaccagggaaaaagagatcagggttcaaaaatcttttatcttcaaaaggcagacagctaggcaagaaatggctggtgttccgtaaacatttttctaagagtatcttctctctattgtttgagtttaaagtttgaggttatccttattttttattcttcagaggataactcttctttctttcaagctttttttttttctttcaaatctcagtatacaccagaagacttctttccagttttaagaaactgacaagtaggtatttgggtattttgtctttaagtaccaaatctggaaataagtaactccgaaacctctcagtctgtaggcaaaagtctatttttctacagtaacttctttaatgtttccttttctgaggcttcctccgatttacactccttcccattatttaaagggcagttgggcgggggaacaacaacaaccacaacaacaaccacctaggtttattggaattgccataatcaatttgtctattccatctatgttttaatcgggatctttccatttagccttaattttactgactacctcattatttcgattccattttttcatcaaaggatgttgtaattttaaaatatgtttcatcgcaatgttttagctttttttcatctaattctaaccagatgtatatatttgtttgagaaagggtctcactatgttgccttggctggacttgaactcctgagcaccagcaatcctcctgcttcagcctccagagtagctgggcttatagatgtgtggcaccatgcctcacatttaatctacttattttttttccctgatcagttccttttaatagcctttgtgttttttatcctttccagccctgttactgacaattccaatttcttcacattttggattttttctgtttcttctgctaccattgttttctctgggtttgtgcacagcttttctctttgctgctgttccacagttctaaaatccagcctgaggtgctatctttgtttaccgtaattgaagtttgtctacttgaatattttttaaaaattcagatgtttgttattttggtgagtctatttttactctgccatattcctagtaatttttttttttttttttttggtgagatgcagtttcggtcttgttgcccaggctggagtgcaatggcacgatcttggctcaccccaacctcagcctcctgggttcaagcgaattctcctacctccgcctcctgggttcaagcgaattctcctacctccgcctcccgagtagctgagattattgacatgtgccaccacgcccggctaattttgtatttttaatagagatggggtttctcctagtagaggtctggtttctccttgaagacagtttgaggctggtcttgaactcctgacctcaggccttggcttcccaaagtgctgggattacaagcgtgagccaccatgcctggccattttctctatttttatgtaatgatgaaatctattttcaatgtaaatcattctattagatctttatgagacttcactttgagggcaaagaagaatttgacgtctcatgttccctttgttttttaactgttcttttcacaggtatggatttaattcttttctttcttccttccctttcctccttccttccttttcctccttgcctccttcctcccttcctccctccctcctcactctgtcgcttggattgggtgcagtagtgcaatcatacctcactgcagcctcgacctcctgagctcaagggatcctcctgcctcagcttcccgagtggctgggactacaggcacatgtcaccatactcagctattttttgaatttattttttgtagagatggggtttaaccatgttgcccaggttggtcttgaactcctggcctcaagtgatcccccctgccttggcctcccaaagtgttgggatcagaggcatgagccaccatgcccagcgcctttcttcttctgtttttgtgccttagattcagtagaactcaaattccctcctgacatctatatcccaggcatgagtgtgcatgcagtataattttttttttttttttgagacagagtctcactttgtcacccaggctagagtgcagtggcacaatctaggctcactgcagccttggcctctcgggttcaagcaaattttcctgccttagcctcccaagtagctgggactacaggcacgtgccaccatgcccagctaatttttttgcatttttagtagagatggggtttcgccatgttagccaggatggtcttgatctcctgatctcgtgatccgcccaccttggccttttttttcttttttttaaaagaggcagagtcttgctgcatcacccaagctggattgcagtagcatgatcatagctcactgcagcctcaaactcctagggtcaagggatcctcttaccctggcttcctaaagcattgggattacaggcgtaagccacaactcccagccctatacttttacaaagaatctgctaatcaacatttaactattgacttctacatgattcattgttttttgattaattgatggcagcactcttaggaatatgggttagggggaaacaacacagagtgatgcagagacagaaggaggatgaaatagaagacaagttataaaggaagaaaatactctcaggttgaaatttacatcataattacacaaaggcagtgtgaaaagaaatacgaagcaatgagcggttcccatctcaacatgaaataaactctaggggtaataccataactacttaattttagaaaaaagctgatttagttcccaagaaaacatgtttttttctgctgtgaggaaaatcaaaacgcaacaggacagcaatacctcattttggcactcaaaactatcctctaattatctgcagatgtttaattttaaatctctctcaagtttgatgaatgggcctgtgagcctctttactcagagccaatttttagtctacattaaagactcattagctcctggttctattaggtcagcataacagatatctgcagagcacaaaacaaatatgattcttaaaaatttggtgtttccatgaaaagaatcccataatagaggattcgatgagccacatgaacagaggttctgagattctcataatatttaaagagctcagcctcttctgtgattgtactggactcttggaaggggatgagtgggaacataatttaaagagttttcactgcaggcagtaatttacagtaaactagagagtattcactcttaagaggctggctagatatatgagaaaaacacaagcaagcataggtagagatcatgtaaattagggaaattaaacaaaaattttccagatgtataggtaactaatcacatatgtaagcatcttcaccttcagcagcagcagcagcttaaaataaaaaaaaaaaattttttttggtatttcaggctgggcgtggtcgctcatgcctataatcccagcattttgagaggccaaggtgagaggacagcttaggcccacgagttcaagaccagactggacaacatggcaagactccgtctctacaaaaaaatttaaaaattagccaggtgtgatgatatgcacctgtgatcccagatactcaggaggctgaggtgagaaggttgcttgagcccaggaagtcaatgctgcagtgagccgtgatcatgccactgcactccagcctgggtgacagagaatgatcttgtctcaaaaaaataaataaataaaataaaaaataaaaaaaattggtgtgtccagtaactggaataaacagcacttatcattaatgttaacctacttattcactggaattaatatagagatggctcatgaaaagaaactcttttttttttttttttttttgagacatggtcttgctctgtagcccaggttggaatgcagaggtgcaatcacagatcactgcagcctcaacctcctgggctcaagcaatccttctgccttagcctccccaggagctgcaactataggcatggaccatgaagtccagctaatttttttatttttatagagatggggtcttgctattttgcccaggctggtctggaattcttgagctcaagggattctcctgctttgacctcagaaagtgctgggattacaagcgtgagccacagcaccaggcccatatgaaattttttgaaaaatattttggataatagattatgttatttgaaaatggctgtatcttttttaatccttcaagaaaaccaacctgattgtaaagaagaaattaaaatgattatttgcaggtgacggtaaaataaaaaagaatcttattaaaagaacaaaaagaatacttactaataaatacatgcaatctgtattaagaaaatataaaagacacaaaagaagatgtgaatgactaaaataccctcttcttggttgtaaagacgctaaatattataaagatgtcaattttccttaaatctatcaatttaatgcagatacaattcaaaaaaactgacagggtttgtcttttctgagaggacaagagtggtaaaaaggctaattctagtttaaaagtaaaaatgaaaatgaaagcacagccagaaatactctaaaaaagaaaaacctggccgggcacggtggctcacgcctgtaatcccagcactttaggaggccgaggcaggcggatcacgaggtcaggagatcaagaccatcctggctaacatggtgaaaccctgtctctactaaaaatacaaaaaattagccaggcgtggtggcgggcgcctgtagtcccaggtactcgggaggctgaggcaggagaatggcgtgaaccctggaggcggagcttgcagtgagccaagattgcaccactgcactccagcctgggtgacagagcaagactccatctcaaaaaaaaaaaataaaaaaagaaaaacctgtgctgctgacacttgaattgacagatgaacaggacagaatagaaatacgacagttgttgtttaccaaatattttcagctttccatcttccttctgcacacatgtatgactgtattttcctgctgttttgttgtgggtagagtcatgtgactaaaacttgtcagcgagctgtgaagggaactgatgtatatctctttcaggctgaacattttactgatggtgtgagagtctccaggcccctctttcccttagtcaggaaagctggtaatgttcaagatggtggcaactccattagtttctgagtgagaagacacggagtagagctctcagccaactcttgatgaacatgtaccaaaaggaaggaaaattcttgttataagccattaagattttgaggttgtttgttaccacaacataacctagcctacgctggcagatacaagaaagttaaagaatagcccaaattaatataggaatcataaagctgacatttcccattagagagaaagagagagagatggattattcacaaatgatattgggacaattaggtagccagttgagaaaaaaaattaagatagccttattctttgtattaaaatatatctgagctgtacctaaggtttaaatataaaaaatgaaattatgaaaatattaaaatatatcaaagaattttaaaaataatctcaaaatggggaaggcctttctaagtaaaactcagaaacacccccaaaaaaaatccacagaaactttctgcttgggggaaaaaagtactctcacacattatcagtggaattgtgagtagaattattggcttccacaagagcaactcagcaaaattatacatgcacttacctattgacccagcaattccacatttaggaatttatctttcagatgtacttgcatgcatactcaaagacacatttgtaccaggctcttcacacaaacttgtttataaaagcaaaaggttggaagcaacctaaatatgtaattggttaagtcatagaatatcatcacaatctaatgttttacagttgttaaagaatgataccaggtcagtcatggtggctcacacctgtaatcccagcactttgggaggccaaggtgggaggactgcttaaggccaggagttagagaccagcctgggccaacacagttaaaaaaataatatatatatacacacacacatatatatattttttaattagctgggcatggtggcacatgcttttagtcctagctactcaggaggctgaggttagaggatcatctgtgacccaaggttcgagactacagcaagctatgatcacatcactgcatcccagccaagatgacagagcaagatcctgtctctaaaaattaaaaaaaaaaatgtagatttggcacagttccatgataacattgctaagtaaaaaacaaaacaaaacaaaaaaacaacacacaggacagtgcatgtggcatatcacctctgatataaaaagaaaagagaagctagctttgtatttgtctaaaaaggtctctagaaaaatatataaaaaactggtatcagtgattgagcctctgacagggctggaaggagaatgacttcactgaatacctgtttataatatctttagtattttgctgctaggatatgttaatgttacctattaaagagaataaaaaatttaattgtaaatggaattggaagaagctatttttatttttatttattttttaaacaacttttttttttttttttttttttgagatggagtctcgctctgccgcccaggctggaatgcagtggtgccatcttggcttactgcaacctccgcctacctggttcaagtgattctcctgcctcagcttcccaagcagcttgggactacaggcatgtgccaccatgcccagctaattttttgtatttttagtagagataggatttcaccgtgttagccaggatggtctcgatctcctaacctcatgatccgcctgcctaagtctcccaaagtacagggattacaggcgtgagccactgctccatgccttaagaagctatttttaaagaaaattgtcccagttgtttgtaaagattcacagaaatttaaaaaccttgattcttatttaaaagacttagttgaaaatcctggctttttctggataaatgtagtgaggaaaaattatcacaaggataattagatacttcacaaatatcctatagctatctgtcttaaatcagcatttgcttagataaggtaatcatttaatgatcattttaattatacatttataattatatataaattgtttcttctcagttgtctaatatctctcgaatgacagtaaaataacatgaataatgcacattattgtcttaatctaatgagattgccgtttcatgaatagaatatgtgtggctatatacacacacacacgcacacacacacacacacacacggaatttccatctatacttgctaatacactactttttactgagttggaaaatgtactccttgagcgcagaattacattgattgtaatcctctaatactacattgattacatccagtgtagcaatacaatactccttgaggataacagagatcttactcattactttacccactcaataacagttggctttttaaagtatttctctttattcaaaggtaagcactactgatgagcagctctgacttcactaggaaatcttccatgtctttgatctcttttggttttggcattagactgacatttttggagaaaactctgattgagctatgtgaggctactttagtaaagcagttatatcaacatacaggaagaataataattacaatctggttgaaaccacactgcagcactttaccaggcagaatcagagcatgaagccacatgaaatacggacttagaataaactttagatgtaagtttgtaacacagattacaaacttggatgtaaaacaagaaatataaaatttcatcacaggtacctggtagcacttcagtattttgtcttttttttttttgctgttgttcatttgtacacttcagtattttgaataagctccttgttttcaattagttatagaataatttacttctgcaaacaaactacaaggttgtaagtctcgtacaattggtagactggacattgtatctctctagggtctcccttgaaaatagctccatggattccattaatgactttggctttaaatttcatggaaactgacagatttgggattttcatatttgaaattctcttcctagtgtcataatttccaaagcaaaaaggctagacattggcttaaataagtcaaaataatatgcaagtaaatctttgtattaaatagactacagtgttcagcttactactttgtttctttgtcatattggtttaggttcaaatggattgttaataataaaaatgttataagcacaattttaaatatatcatctatggattttgattacatccaatgtagcaatacaattaatctaggaaaaattacctaaaaagagttagcctgatgtataatccctgaaactggagaaccttttttttccaagtgattaatttggatattaatcaaaatgaacattttacattgtgctttagagtttgtgactaggttgtatacatattatttaatccttataatcactatgggatagatattatgctccccagtattcagatgaaaaactgagactcagaaaagtcaggctagctgcccaaactgaaaccactagtgagtggtagaagaaactgaaaactcacatctttttttttttgaggcagagtctcactctactacccaggctggagtacagtggcccgatctcagctcactgcaacctccacctcccacattcaagtgattttcctgcctcagcctcccgagtagctggattacaggagcccgtcaccacacccagctaagttttgtatttttagtagagacagggtttcaccatgttggccaggctggtctcaaactcctgacctcaagtgatctgcccacttcagcctcccaaagtgctgggattacaggcgtgagccaccactcctggccacatatctgaaatcaaacctcttactcttcccatgagaacctgctgccttccatggaccttgataagcctggactgcactggtagggttagaatggatacacaagtaaaaacaatttccgtggttggttcctgtgggcagttagtatgctgatgcatcttggatcatcttcactgccttagagggcctccagaaaggcccacaccataatttctaaataactggcaacaaggtatatatttttaaactttttattttgaaataattttcgatttatagaaaagttgcaagagttcccaaatacccttcgcctaacttccccaaatgttaaaatcttacctaaggatagcagaaagacaggaaatcaacagatataatcctattaactaaaatacagactttatgcaattttcaccagctttcccactaatattctttttctgttctaggatcccacattgcattaattgtatctctttagtctcctccaatctgtgacaaagaactgtgtcttttaaattaaaattaatcaatgttcattttattctgaaaatgtcatggcacttctcgaaacagtattgaatattacaaacctcctttgggaattgctaggtctatgagataatcaagaaaacatcctgaaataaagagccagagtggccctaaagatagaaaaaagaaaatcactctttaaataaaggtaggaattggctgtgacaatctgaatgtatcagttgtatttgtgacacctgtccatcaacagtcagttataactccccggaaaagcacagggttaaaacacctacctctggagtataacagatagaaatcaatacaactctgtttaatggagcagtcattaaagagttatttcatttgttttaaattaaaggagttgagtttgttcattctacagacagggtaaattaataactaaattcaagtatacaaaggtgattagaaggcactaaattttctctacatagtgatctccttttctaattggtagcataaagttgctgaactgtcagtgatcctaattcaaaaccaaacccctgggaaaggtgacgagtctttggaccctgttgaagctactctgggagaagtgtcaacagggttctctataaacctcgacagctcacttcttattcttgaggattctagattgaacacattaattccaggactttaatggtgaattcttagttacccaaaaaggtattagaattcctacaggagtttagaatccctgaagacaaaagactagaatgcataaactgcacgtactaaaagtgaaataaagaagtttagtaaaccacaagcacttctagagtggtaaaacagcaacaagctaacaaatgaaaaatggaagattctttcattgtacagccttaaaagtgagagaaaacaatgtcactgatagtttagcaattcatagccaggaactgagagcaaattagagaaagctgcatggcactaagtgggttccatgaaagatggcatagcagaggcagtaaccttacagagttgagtttagccacgccccaccacggggacttgtaggcaagtctcaatgtcccatctataatatagggagagttacccacatccacctctggggtgtgcctggcatatagtgagtgctcatcattcccatcaggtctctttttgttctctggtgtgaggctggcattggggttaggaatcatttgggcctgagccacatctccctgggccactctgggttagatctacatctttgagcctgaaccacaagtggactcctttctgaagtgacaggggcagggtacagaatactgagaaacagacattagtttagccacatttcttcaacaacaatttccagatagccaacctgtataaattaaaaccctatctgtttttagatctaaattttgtagaaggaaaattctacagccacaaaacagcatctaagatgttcatgactaattcagcattcttcaaatggttatgaatcagcaaagtgtgcaggctgcctggtagtttgacactggtgataattaccttgcatttctaaaaattacagtcctaagcactgcctggaagtctcccctttgtttactaggatcacctcgttcttttaagaaagatatgtgaagacttcatctttaaaatgattttaggcagccaatggaacaactgagacgatggggcagatcaaatgttatttcaatatttggggggtgaatttggttctgcttttttttttcaaaaatgctgaaaaatcacaatcatttcagaacagtgaataatcctctaaatgagtcttaaagaatcaagacttgcaatttcattagccctgaaagctctctttcctttataaaaatgttttacaagactactactaatcttcatcacacaaagcgctattattctggttttatagatggatatattgaagactatacaagtttgtaatttttctcttccttcaagatcaggaatgaatgatgagtgcctcaggtcatatgaagctgtacaagatatatgctcccagtaaggtcacagtacgtcaagagttgggtctattctctacttcatcattttccccaggggctcacagactcactggaaaaatttacacttaaccaaactcacaagaggttggctcataaaccataatatcaactccaaaattcaaaccagaaaatatatttagcaggtttcttttggaagattctctgcactaacacaattacagaaaagagaatgacatattctttttaaaatatatatattttgtagagatcggatcttgtatattagtatattctccgaatggacatttccatttagagaatcagtatcggctacgagaaacagaagcctccttctctagaggaagctagagaatggtagctgctctttggttttccttttgtttatcattaatgagtctgtatcagagactgatggttttctgtcctaccccaccctcaatatctgttctccctttcttccacttaattagaatttttggttgggcatgtgactacacttcctagccttccttgcagctgtgcacggccatatgtctcagttctggccaatgtaactgatgcacatgaagttgtctgggaatcatgcttaacagaatactgacaggtgccttctatcttctgcttcatccctttctccatcctgtacctgcaataggtgctaccattttcctcaataaaaatgaggtttacacccaagaggagggcagagtggtaagagagaactaggagtaagtggtaaaatgtccctgatgccatgaagctccattccagatctgtaccaacttttacatgaataagaaatacattttaggctgggcgtggtggctcacgcctgtaatcccagcactttgagaggccgaggcaggcggatcacgaggtcaggggatcgagaccatcctggctaacacggtgaaaccccattctctactaaaaaaaaaaatacaaaaattagccaggcgtggtggtgggtgcctgtagtcccagctactcgggaggctgaggcaggagagttgcttgaacccaggtggcagaggttgcagtgagccgagatcgcgccactgcactccagcctgggcaaccgacagagcaagactccatctcaaaaaaaaaaaaaaaaaaaaaagaaatacattttaatcttattttaagccacttgtttcaggttttctgtcactcacagctgaaaccttccaatatactgatgttctaggtaggtcagtactattttaaattattttgtattcacagaccatttagaataacagatcatggattctaattctaggtcagaaaaatacaggattttttttttttttgaggcagggtcttgttctgttgcccaggttggagtgcaatggtgtgatcatggctcactgtcgcctcaaactcccatgcccagacaatcctccctcttcagcctccagagtagctcgaaccacagacatgtgctaccacgcccagctaattattttttttttccacagatggggtttccctatgtttcccaggctgctctcaaacccctgggctcaagtgatcttcctgctttggcatcccaaagtgttggggctacggatgtaagccactgcacctggacagaaaaatatggcttttgctaagactatagatacttatgacactacattaggcaactaattagaatacaggaaatctaacattacaatgtaatctttttgatatgatgtaagaaataatggggaccatcggcaatacatttgccaattattttcacagaactacattcagcactaattaagtatcgcagtccaaatgccccacttttcagaggaagagattgaggcacacagacgctgggttttcaaagctaaaaggctggcttttatttttcaaactacatccaaaaatttgagggggaatatgctctaagggttgcacttctaagtatcctgtccccaacagctcatttatactaatatgcaataattggttatcctgaaataaaatacttagcattcagcccatcaagctcacataagaataaaaaatgtggccaggcgtggtggctcaggcttgtaatcccagcactttgggaggccaaggcgggcggatcacaaggtcaggagttcgagagcaacctgaccaacaaggtgaaaccccgtctctactaaaaatacaaaaattaggctgggcgttgtggctcacgcctgtaatcccagcactttgggaggccaaggtgggtggatcacctgaggtcacgagtttgagaccagcctgaccagtatggtgaaaccccgtctctactaaaaatacaaaaattagccaggcatggtgggacatgcccgtagtcccagctacttgggaggctgaggctggagaatcacttgaacccgagaggtggaggttgcagtgagccgagattgcaacactgcacgccagcctgggcaacagagcgagactctatctcaaaaaaaaaaaaaaaaaaaaaaaaaaaaaaaattagccgggcgtggtggcgtgtgcctgtaatcccagctactcaggagtctaaggcaggagaattgcttgaacccaggaggcggtggttgcagtgagccaagatcacgccattgtactctagcctgggtgacagagcgagattccgtctcaaaaaataaaattaaattaaaaaaaataaataatgtaacacgtgactgggtgtggtggctcacacctgtaatcccaggactttgggggtcaaggcgggtggatcatctgaggtcaggaggtcaagaccagcatggtcatcatggcaaaaccccatctctactaaaaatacaaaaattagccgggcgtggtggtgtgcacctgtaaccccagctactcaggaggctgaggcagaagaaccgtttgaacccgcaaggtgggggttgcagtgagccaagatcaggccactgcactcaggcctgggtgacagagcaagactctgtctcaaaaaacaaaacaaaacaaaaaacaaaaatgtagcatgtaaccatagatatcatataagaatgtctgagttatgcaggatagtcagctggaaaattagttacaagagaacagcaaataaaagtgagagtgttgcaacagttttagttacaacagtcctatagagttgcacattattatcctttgtactgaaagattcactaacaaccatgacattattcatatatacaaatgcagctaaaaggaatgatgggacatgaatcttttccacattctacactagaacaccattcttaggtctatagctacagtaaccgtttatagggcttttctcgtcatttgtgactgaagactcatgaaacactagtcaattttctttgtttaaaaaaagtcacggccgggtgcagtggctcacgcctgtaattccagcacattgggaggccgaggcgggcggatcagctgaggtcaggagtttgagaccagcatggccaacatggagaaaccccatctctaccaaaaatacaaaattagctgggcgtggtggcgcatgcctgtaatcccagctactcaggaggctgaggcaggagaatcacttgaacccaggaggcggaggttgcagtgagccgagatcatgccattgtactcctgcatgggcaacgagaggcgaaactctgtctcaaaacaaaacaaaacaaacaaacaaacaaaaaaagtcacttcatcttttcttccttcaggataagtcagtatatctctaagagccttaagataaaaaagaacatggatgaaccttgaaaacatcatattaagtgaaaaaagccagtcataaaggatacatttttaaaatcctatttatataagaggcccagaataagcaaatctatagaaatagaaagtagattggtagttgcttagagcaagggaagggggaggagcggggagaatgaggggactgaggagcgaaggccattctttttggaataatgataactaaaatgttctaaaattgattgtggtgatagacagaaaactctaatattctaaaagccactgaattgtacactttgagcaaactatatgggatataaattatgtctcaataaagctgttaaaaaaaggcaaaagagaattgcctaaaacaatcatcaaaaacggtattttaatggccagatgtggtggctcaagcctgtgatcccagcactttgggaggccgaggtgggtgggtcacctgaggtcaggagtttgaaaccagcctggccaacatggtgaaaccctgtctctactaaagatacaaaaaattagccaggtgtggtggcgcatgcctgtaatcccagctacttgggaggctgaggcaggaaaattgcttgaacctgggaggtggaggctgcagtgagctgagatgaagccattgcactccagcctgggcaacaagagtgaaactctgtctcaaaaaaaaaaattatattaatgcatatataatctccttaaaagttaagaactatgtagtacagttaggcagttacaatttttacatcatctgacatccaccgaaatggaacttctgaccagccacagttcagcagccaggctaagctggctgcataactgaactcatatttataaaaagaggggaactgagatgtagcaaaaattgtttgttgttattccttgcttaataacaataatcattaggagagctaaggagataaactacactcacaataactggaatattcaatgataattatccccattttgaggctaaatagtgattcaccaaggccaaataggtaacaaataatagggtcaaaacttacttgaatcccacacgcttttctgtatatcaccctgcttcttttttacctttatggaaatttacttggaacttactatgcaaaaatatatgtggccaggcgcagtggctcatgcctgtaatcctagcactttgggaggccgaggcaggcaggttacctgagctcaggagttcgagaccagcctgggcaacacagtgaaaccctgtctctactaaaatacaaaaaattagccgggcgtggtggcgtgcacctgtagtcccagctacttgggagtctgaggcaggataattgcttgaacccgggaggcagaggttgcagcgagctgagatcatgccactgcactccagcccaggtgacagagtgagactccatctcaaaaacaaacaaacaaacaaaaaacctcatgaagagccagtttttttcaaattacaggaacttttaagtcagatcatatgtaaaatgcctgaaaaaatattaaaatgatatcagatctaataaactcagaagtgaactaaaacaataaaatgtagtggggttattcatcaagtgcttcttaccacaaatgtagctttctgtaaattcaggctgaatatgaggcacataaaatagttattgatatgaataaaggtaagattgtaaatccaaaacacatattggatgaaataattgaaatattacttaaaagacaaaaatcacccttatttctggtagaggaaagaaagcagaatgtgtaagatttgtggtcaccaaagaacaaagtttcaggccagcatggtgaatcacgcccgtagcccagcactttggcaggccaaggtggaaggatcgcttgaacctaggagttcaagaccagcctaggcaagagagtaagacctcatctctataaaacttaaaaaaaattaataaataaacagctgggcatggtgacatgtgcctgtagtcccagctactcagaaggctgaggtggagagattgcttgagcctggaagttgaggctgtggtaagctaagattgcaccactgcactctagcctgggcgacagtgagaccctgcctcttaaaaaaacaaacaaaaaaaaacagggccgggcgcggtggctgacacccataatcccaccactttgggaggccgaggcaggcagatcaggaggtcaggagatcgagactagcctgggccacatcatgaaaccccatctctaccaaaaatacaaaaattagccgggcgtggtggctcatgcttgtaatcccagcactttgggaggccgaggtgggtggatcacgaggtcaggagatcgagaccatcttggctaacacagtgaaaccccgtctctactaaaaatataaaaaaattagcccggcgtggtggtgggcgcctgtagtcccagctactctggaggctgaggcaggagaatggcgtgaacccaggaggcggagcttgcagtgagccaagatggtgccactgcactccagcctgggcaacagagcaagactccgtctcaaaaacaaacaaaaaacaaaaaaacaaaacaaaacaaaacctcagcaaagaaaggtaaaagataaaggataaatgaaacaaatgtggcaaaaccttgttaattgttgaatcccactgataggcacagggccataataaaaaaatttaaaagaagaacctcactagcagaaaagtctgaaaaaatagtgtaggtaagtctattaagtaatattaatctcaggtagaaaacaaaaggatcaatgaaaaaagtcatggcagttgattatttagaaacagaataaattatatggaaaatatcattttttcctcagatatgaccagacagctatataatatagtttcctgaagtaggttatttcactggaaatcaacagtagataaaatacagtttttatataatacatttttaaaaaaaactttaggaatgcagctgtccatttactccccttagaactgtgtcacgcttttatataattctggtgttctaaatggatggtggtagtgaattgaaatagagaaaatgaagacacagaaaacagaagtcacagctgcattctgaactgaatgctttgaatttttctttttcttttcttttttcttttctgagacagtctcactctgtcacccaagctggggtgcagtggcgcgatctcagaacactgcaacctctgccgcccgggttcaagtgattctcctgcctcagccttctgagtagctgggattataggcgcctgccacggcgcccggctaatttttttgtatttttgtagagacagggtttcaccatctgggacaggctggtcttgaactcctgatctcgtgatctacccacctcggcctaccaaagtgctgggattacaggcgtgaaccaccacgcccggcccagaatttttctttttgtgtaatcattttctaagaatccagggcctccttcacatcccttctgaaatagtattttaacttttaatatgcaacatttacaatatattccacacacagcgctgactaagtttctttggaggtcaattttcaaattatcttccaagcaattcaaagtaaacagaacagaaaatcaatagttttccagaaacatcttcaaagcataaaacatttcatttctaatagagcagtagttcttaactttttcttagggttatggaaccctctgaaaatctattttgaaagaaaatctacatatttctttcaaagggttttatcattgttttgaaggcccatgttagaaactcctttttttttttttttttttttttttttgagacagagtctcactctattgcccaggatggagtgcaatggcgtgatctcggctcactgcaacctctgcctcctgagttcaagagattctcctgactcagcctcccaagtagctgggattacaggcatgtgccaccacacctggctaatttttgtaatttttagtagagtcagggtttcgccatgttggacaggctggtctcaaactcctgacctcaagtgatctaccccacctcggccttccaaagtgttgggattacaggcgtgagccaccacgcctggccagaaactcttataatatagcattcttatggataagcaactctaaaccaagtacaaattcatcagctcaacactaaaggcctcccatgaattggcccggacttttcatcctcattctccactatttctctaaataccagactttagtcaaatgcattagttatcgttcctgaagatgactccctatcttttttcttgatacttccactatctgcacatcccaggctatccccaactatctcataaaattctgtccatccttcataatgtacctcaagcaatacaacttccatgaaacctgccttgaccccataaaccttcccctgaacttcaatcttctgtctttctatcttccaatatttttccacactttgtatcatggtctgctgaatacttgtctaatctcggattctgtgtgagacagtagtcaaagtaaaaattattaccaaggaaaaatcttactctcttgagtggattgaatggtggccctcaaaaagatatgtccatttcttaacacaaggaatcggtgaatgtgactttatttgaaccgactttatttaagaaaaaaaaaagggtctttgcagatataatttaaggatctggagatgagagcattttggattatctgaatggattctagatccaatggcaagtgtctttataagagagaaagagaagaccatatgaagacagaagcagagactagaatgtgtggaatcaccaaaacctggaggaggcaaggaaggattcccctctagagtctttggagggagcacagcaaccctgctgacaccttgattttggacttctacctccagaactgtgaaagaacaactttctgttgtttaaagccacgaagtttatagtaattgtgttacagcaatgttaagaaactaataaaccccctttgctccatctgattctgacaagtcatttttatttactgcagtagctctgcaggagcatcagaagagatttaaaaaatatagattctgccccctaccccaaatctcttcttattctcctgctattatctgcaaagatctctgcacttccattatcaatagccctccagaggtgccagtacaggataacatctgaatagtaaagagactgtattcttgtgaaaagttgataacatccactgtgacaggtggtgggctctagaggatgaaggcctaggttcaaaactggaccctgaacttgtaaacctgaacaggttacttctttgacatttagtttgtcatccataaacaactctttgaggattgctgtaagcagtaaataggcaatatatttaaagctactggcataaaagctttttagtgtaggttaaccaatatgaaagatgattttctgagtataatattgcccctggctattgatatactgttctgtgatttaagaaaaaaaaaatcttactacgccgaaaattccatctgccctgtttacagagataatcgacaagtttgagtaaaagcctttatttaattatagccatgcatgagatttccaacacatttctgaagaagttttgcaacttgtttcatgctgaagaaaatgaatgaaagcctacacctttgatttcccttcccacccatttcccacaaactacattaactcataatttgacgtttcattatctgtcaacttttttcattcagtccaagataaagagactatttagatataatatttaggttctatttcaaatttatatcactgagcataatttcacatgctcagatttgggaaggaacaataaagagatacaggtagctataatttttttttggtttgccaagatgaacttaataaacttaacagatactgcagcaccattcaatctgcacatttgaaaaaaaaattaaggcaacataaagcatactgatagacagcagtgaaactattaattttgagaattcaataaacactgtcatcaaatgaactgaatgctcattattcttacagtatgatatttgcacttattttgctgtcaattaaacaattatgatattaaatctgctaaaggaagtgaagaactgtatctgatacaagcacctgtctaatcgggaaaacataagtaccatcaaaatgagagacaagctaagactacatacataattaaccttctatagaatctatggtttatggctaggtgtggtggctcacatttgtaatccccgcactctaggaggctgaggcgggtagaacacctgaggtcaagaccagcctggccaacatggtgaaaccctgtctctactaaaaatacaaaaattagctgagtgtggtggcgcatgcctgtaatcctagctacttgggaggctgaggcagaagaatcgcttgaacccaggaggcagaggttgcggtgagcagaaagagcaccactgcactccagcctgggtgacagagcaagtctctgtctcaaaaaaaaaaaaaagtctatggtttacacaggagcaagctttacaacaagatggaaaaattttcctaattcaaatgatcaaaactttagaagatgacaacaaaaggaacgggcaaacctcactttaagaaaagttgacaaataaaaacaggaactttaaaagcaggtaacctggaagttacttacaatataaaaacattcactacagttcattgcaactttaatacacctaacagtagtgaatccataaaaattcaaattacattaaatttccagagcaaatttgtaacacgaggttcacttgtaacattatctaaatagcagtttcctttcccttgccactgcaggctttctccaactccctggggtactatggagggccagtgcaactctctggtatcagactatccttagggcacatggagggcccaggccagctttcccaagagtggccagccaaaagcaaggccactggccagctattcttgggccagctggcatggaacaaagtgtctggttcctacctccaaagcacaggaggctctgccagctggctttcaaaggactgcactagttggaatgctcacagttcctttcaaaccatctggcattcttttagaaccctcaatttacccaacactacattctgagatttgaattgctcagataattgaaggagtccccactacctacctaggtaagaaaagaaagaggcagagcaaacgctaagtcaattacttcaagaaacagtttctacaactaaaaactgctctcaagtttagcttgtatattttgtattttaaaatctaaaatattcccatgattattaagcaaactttcaaagtaaaaaccaagacaagtaataagagaataagctaaaacagactatttaacatgcagaaaagctgtaggaatcccttagggttagaagtacctgactctccctagcctgaacttctacagagcctgtctgtattttttatgtggtcctcagaatatacttcgtactgctacatatatttaccctcccagctagctagtagatgaaaagaacattgtcttatagctgtttcaaaagaaaaaaaaatctgttgatgatatattgggtgtttttaaagctccatttccagaaataagaaaacttaatgtggaataacatgaagaaagaacctcacctctgagaaaaccaaataaacaaagaacaggacttggcttgaaataaaaatattttatcaagtgatcaaaatgatttattggctgggcatggtggctcctgcctgtaatcctagcactttgggaggtgctggtagggtcacttgagcccaggagtttgagaccagcctgggcaacatagtgagaccctgtctctacaaaaaaaaaaaaaaaaaaagaaaaaaaattagcctggcatgctggtgtgtgcctgtggtcgcagctacttgggaggttgaggtgggaggattgtttgagccctggaggttaaggctgcagtgagttggagatcacaccactgcactgcagcctgggcgacagaacaagactctctctcttaaaaacaaacacacccccgccccccacaaaaccaagaacagctgaatcatcatattgatagcccatataccctaggagatatagtattttgaacaaaaatattatagagaccaagtcagagtcaaatattataaactggaggaggctataataattactattatttttcattgagtttactcccaagacgagtactgagtttcgtgttttacatattatctcatttggaacacaaaacaaacacatgaggtaggaactattattaaccacattacaaatgaagaaagagagaggttaggaaacctgctggaggtcacatagcaaaaagtgaaagagctggaattcaactccaagcagtctgatgccagagtccaggtgcaagactgcaaatatatatatatattatatatataatatatatattatacatgtaatatgtataatatatatattatatatataatatatatattatatatgtaatatgtataatatatatattatatataatatataatatgtataatatatataatatataatatataatatgtataatatataatataatataatatatatattatacatattatatattatatatatattatttatatatattatatatatatatatttttttttgagacagagtctcgctctgtcacccaggctggagtgcaatggcacaatcttggctcactgcaacctccacctcccaggttcaagcaattctctgtctcagcctcccgagtaactgggattacaggcacccgccaccacacccggctaatttgttgtatttttagtaagatggggtttcaccatcttggccaggctggtcttgaactcctgacctcatgatccacccgccttgacctcccaaagtgctgggattacaggcataagccaccatgcccggcccaagactgccaatattaagtcatacttatgaaagaatgaaatgtaacatagggcaaaatttgatcattaatatattcttcataattgtttcaattcttaagtgtagcaaaaaatggtgagtaattaaaaaacatggattctcttgttagaaatttttaaaaatcaaaagctattttaccaggtcagttgtgcctcttttgcccatgtactgagtagacacttgtgccacctgctgtcctaggggacagagtggtaaacaggacagatgaggtccttgccttcctggagctgaccttctattaggggtaagtcacacaaaaattattaaacaacagaatttcagagggtggtacgtactatagaggaggtagggaaggcacgtaaacttctcttttgagagacttaaccatgtaggtaaatagaaagggatagaggagggtcagggaaaagttgtttgctgaagcttattctgattttaaagatgggcaacgtcacggcatatgtgtatgctgacatggatagccccctggagagttgctgatgatgcaagagagagggcaaaaatgctaaagctgtgagatatgagggggcatgaggtatagaagatgtgaggaggaacacagtagaaaggggagcttgcctccgacaggagacagaaaacatgggtctaaggaaggcagatttctacatttggttggggggaagatgagtggtttctgtctgatatctcctaaaccctcaatgaactatgaggtcagcttatctgagtaggaggggtgggttgctgataagtttaaggagtggagagaagttatgaaatagtgataggcaaaaagatcttattaagattcaatggtagctttgccgggcagtgctgagtgtctacttcggatttttggtcatgaatctgaagttctcttgtaatatccagccacttgggtggtgtcatggaaaagccaaatgaatgataaagcagctataaatagaaaaaaaagggtttttaattttaaaatttttaaagagtaaacaaaggatgttttaaaaatatgtatccaaattagccaggcatggtggcgggcacctgtaatcccagcaactggggaggctgaggcaggagaatcgcttgaacctgggaggcagaggtcgaagtgagccgagatcacgccactgcactccagcctgggtgaaagagtgagaccctgtcacaaacaaacaaacaaacaaacaaacaaacaaacaaacaaacaaggccagatgcggtggctcatgcctgcaatcccagcactttgggaggctgaggtaggcagatcacgaggtcaggatttcgagaccagcctgaccaacatagtgaaaccccgtctccaccagaaatacaaaaattagctggacatggtggcgcacgcctgtagtcccagctactcgggaggctgaggcaggagaattgcttgaacccgggaagcagaggttgtggtgagccgagattgcaccactgtactccagcctaggtgacagagtgagactccatctcaaaataataataataatatgtatccatgagataaacacaaaaatactgacaatgttctgtgaagctgtgatttatgcagctccttttgcttccatcttctcatcacagaaattcttgcaaacaatatatttgtcacatttaataatgacatatttaatcatgaagctcaagttagtttctttttggtcatttctttttttgtcatttcctaaggtggatttttaaaaaatgcacctgacagccgtcatgttggttcatttcactgcttaaaagaaactctctctgatgtcaattgatattttcattgttgatttcatttaaaagtaaaaaaacttaatcccctctctcaatgaacacatacacatctacagtgcttaatctcaatgcctaaacagtggtcacaaggaaaatgggaagggagatgctggcctgatggcgctgggcacctagcagtgccaggtgcatgttcttgatcttgcagctgtgctcttaaaacacaatgctcaagatccaaaacgttcgggggagaattcctgtctgcacaggttcaagaggaggaaacaaagaccccactgcttgatggaggcacaaagaatagcatattgggtgagatggggggagtatgcacacacatacatatacagcctttttggaaaatacaatctaccccacaagcaaaagtaaagaaaaatatctattccaaggtacatcatgaaatgtcaggaacaccagggataaactgaagatcctaaaatctttcagagtgggaagaaaaagggaatgaggattaaaatgacattggacttctcaatagtgacactggaagctaatggaacaatgtcttcaaaacagtcacattaattttcaatccagattttaacaccaagctaaactaccattcaagagtgaaggtaaaatgaaggcatttccagacatgtaacttctgaattcaggaaggaatttcagattttgtatgtaccctttctcaggaagctactcaagaataaggaagacacagggtccaggaaatagaagacctaacacaggaggaaggcaaagggaattcccaagatgatgacaaagggaagtcccaggatgatggctatgcagtagtccagggagcaaacaattccagactggagtaggagagagggggctccagcaggaccatctcctggggaaaagatatgaaagtgagtgactacctgagaatattcaaagataatcagttttgtcatagagtttgaatgaattagtgactgatacaaagaaaactcagcaaatgaaaaccaaacaaacaaaagaggcaattatttaattcaggagcaacaaaagttgttcaagaagaaaacacagtaatagcaccctacgtggctcaactgtgaataacaggtacactgtcagtcatataaatcctgaataccgacctaactgtcaagtatgagtgggaaatggaaggatagttatgtgagacagttaagtcttcaacttccaaaatagaagtccacagagaatatccaaaagtgaagagctaagaaatagcagtataaacattaaaaatgaaataagtataaaggtaaataccaaaagaaaccagtaagagttgagagtggtttaactatataatatataagactgctgattttgattttttctcagtctcaacatggcaatttcatatgattcaagctaacacattgtaatagcattattactgatcttagaataaactcccatttaaaacaataaacaattattggccgggcgcggtggctcacacctataatcacagcactttgggaggctaaggcaggcagatggcttgaggccaggagctcaagaccagtctggccaacatggcaaaactccgtctctactaaaaatacaaaaaaaaattagccaggcgtggtggccagtgcctgtattcccagctattcgggaagctgaggcatgagaatcacttgaacctgggagacggaggctgcagtcagccgagatcacgccactgcactccagcctaggggacagggtgagactccatctcaaaaaaaaaaaacaacaaaacacccaaaaaacaaaaaagcaattattgatagagaatgctcaatggaaaaataaattactttttattatgagacattactgggaggataatagatcctagttaacaaagtgttaccatctatgctcttaccatcactaacataatattactattctaatgaataaatatttactattaaaacagcacttaacattattttatctattttaaggatctaaaagttagtttagattttttcttcaatcatcatactacagaatgctaaactatgggttggcaaatactttgattaacagaatgctgaataacaaggccaggctgtgtttaggttcctttgttgatattaaaaatagctaagtcactcttgcaaaattaaacttccatgaaattgcgatactgtgcaagcttatttcagtgataattccggttatgctactctgtttatctaagacttccccttacggtttgttttaaggagactcctaaaaaatgtcttatgcagtcaagacaggcagtttataaatgtactgggttacttcaacattagtgactttagttagtaaagctcttgtttttttttttctgcttcatttttccttcataaaagccttgttttaaattaacttatctgaattaaattaattgatattaagattttatttaaatcatgcattaaaaccaaaacatccccaattgaaaaatcaactttcattaatttttttttactcttacaaaaaagaatttgaacgtggtaagaattttactaagaataatgtatcctgaactgaccatggaaaatttccccttcaaattaaaagcaaatgttttaaacagagggaatatacataaacagatgctgtggaagactgcttagtttacatttcattttccactgaaaactactaggaattaaaatacatgtgatttttaaaaatattacagagaatcttaaagaaaacagaacccatacaattattcatatcatccaatataagcgcctcttaattttttaaaaccgctattttgaatccaaagatcataataaaaatagcttttttttcagacggagtttcgctcttgttgcccaggctggaatgcaatggcgcgatctaggctcactgcaacctccgcctccgggagttcaagcgattctcctgcctcagcctcccgagtagctggaattacaggcgctcgccaccatgcccggctaattttttgtatttttttagtagagacagggtttcaccatgttggccaggctggtctcaaacttctgacctctggtgatccacccacctcggccccccaaagtgctgggattacaggtgtgagccaccgcacccgacccataataaaaataccttggaggtgtgtttcttgtaaatgagtggctaatttcccaacaccctgtaaaagtatatgggtaaaaagaaactgaaaatcatcatgcaaccagagttaacaactatcttgcaaaattcatatcatttgttttaaaaccaaaatagcaaggaagagctggtgttatcccaatagcctctttttaattggtctacaacaactgcaactcttcataactttaccaacacaacaaagtcaggcaggcagtctgacagagtcaacgtttgtgggaacctacagcgcttccttctctctctggagatgaggacaatgaaaaaaggtgttctgttttccagtagtcctgtaagaggagccattgagctgggctgtacaaccagacaacagaacacaggaaaattcacatcaaagcaagggcgcatgccagggtaatatgcaataaaaccctctgccaaagcattaaggggaaaaaaaagcaaggaggtagagagaacctgctggactaccttctcattaacacagggaggcagaaagaaacaaaatctgcctgtattcaggagcggagaaaactgtgtcctagatatattggagtattcctatagacatgtttatgagcattcggacaaattatcaatgaactaaacccagaaagcagtgtcctgtacggtggagtattcctatgtagacagacatgagaatcttaccattaactaagcccaaaaaggcaaagtattctagaaacacagatatatgagaatttagatgcacatttccaatgaataaaacccactggttttacagtgagaaaaaactgtttgaaataacatcaggtaaagaattgggtaaaggtgtgatgaagttatatcccctccccttttcctcataccctttttgacaatctctgattctctcatttcatagatgtccctttcacttgaatgcgcacacacacacacacacacacacacacacacacacacatcattaggtctccagaaacaaaggagggtccttaattctccggcctgtggaaccacacacgccccctgcccacagatggtgactttcattaatgagtaagccgagggaagaggtctccaccccgaccactgccatgcacactgtgacaacggggcacgagacaagcgccacaaagaaaggggaggagtggacggggaccaggaaaacactgccacgccgcaccccccaaggcgcgcgcccaccgccaacgcgggggcagcgtcctcgccatcctcctcctagcctcccagctcatcccagccgcctcccacgcccggggacccgatgccagggcttgggcgagcaggacgtgcgggggcccacgcaccttccctccgtgatctccaggtgacagccccgctccgccctttgtgagggactcaccctccagtcccggggccgcgccggaccctcctccgcgtccctcctcagcctggagacaccgcctcacccctgcacaccgcgcccggccggccgaggcgccgggagagtgtgtgtgtgtgggaggctggcgcgggcccgcggtctcctcagcatcccgaacccggagcgggtcggtcccccaaaccccagcccgggggcggcggccgcggcgctcccgccctcgatcgctcacttactcgggcgcgccggtggcagcggcagacgtgcgggaccgtcagcgccctgcggcgggcggcaggctgcgggcggcgagcgtccgtccggacagagcgcggcggaggtggcggcggctgactgcgcccggcggcccctcgcgaggggcgggcccgccgggggaggggcgggcgccgcgcctctcattcatgcatcgggggcggggtgagggacccggatgcccgggcagtttccccacccacctcggcggagggctcggcggcttcagagtctgcagtgcgcaggcgcggcgctccctggccaggcctggtgcggccctggccgctggctctgttcctggttagaactacgccagacaggccgggcgaggtggctcacgcctgtaatcccagcactttgggaggctgaggcgggcagatcacgaggtcaggagatcgagaccatcttggctaacgcgatgaaaccccgtctctactaaaaatacaaaaaattaaattagccgggtgtggtggcgggcgcctgtagtcccagctacttgggaggctgaggcaggagaatcgcctgaacctgggaggcggagcttgcagtgagccgagatcgtgccactgcacaccagcctgggcgacagagcgagactctgtctcaaaaaaaaaaaaaaaaaacaactactccagacagaccttctccatcgaccgtttagtatttttgcgtgccctacaagcatttttaaaagtgaaagcatggggccgggcgcagtggctcacgcctgtaatcccaacactttgggaggccaaggcgggtggatcacctgaggtcaggagttccagaccagcctgaccaacatagagaaactctgtctctactaaaaatacaaaattagctgggtgtggtggctcatgcctgtaatcccagctactcgggaggctaaggcaggaaaatctcttgaacccggggagcggaggttgcagtgagccaagatcgcaccattgcactccagcctgggtgacagagcaagactccgtctcacacacaaaaaaatgaaagattggaatgccacccctttcctagcatgcagattgacagtccccagagacacaagaatggtcacgtggtgcccattggtttgatggggagatggtatgcaccgcaccctcctccatctgcccctcctgctgcagcctctcagctgagtgctagaaccttggtgatggatgagacctagactctgcccagatagtggagagaggtgtgtgcaagaaacagtgcattcctttatttacatccactcctcaacctccggctcccattctacagggcaggcaataaattgacctccgattttgggaggctgagctcttcctgcaataccaaggcaaggatctggggagtcctctcttgtctttagcaggcagtgtattctgcagatactctcttgttcccatcgccttgtgtctgccactcctggggtacggaagtttctggagaggctaggagcctgcagagggaatggctgtgaagctccacagctgactgtgtgtgcgctgcagctcagagcttgcaaaaatgattgccccctcttcctcagtctccatgtgtcccccagaagttctccttccttctcctaatctctcaggccccatcacataaaccataaacagctcagtagcttaactttgggaagcaaaagtcatcatggcaagcgcctagaggcatgttccttctgctttggcaaaccattaaccaccaaggcagggaggaagtaaagagggaaacattagtgaatttctcaagaagtcacctgccacccaatggtcacagtcccccaaagtgagagaagggtggaggcatgtgctagggagactgtggcaaaaggaagggagtgggagacccaggcttcctctagagctgcctgtgccagggctgtgctgggggaacactgccctccttgctgtcaatcatagcagttacctggagggtcttttcaactttgctttgctcaaacctctcactgttctaaatcagccccctcatctctcccctgggctgttgcagaagtctcaatccattctcatgcaaatcgattctcatggtattcaaatctgcctgtgtttctgtctttttctttttccctgccccatctggctccttgagccttattttccagccatttacagaacagcaccatggtgtttcacctcagtagtcaccaaggtgactgctgtttcctgctgttcccctactaggaaagcaatacttacctagcatgcaaaagttgctcttttctctgaaaatccacagatgctttttagggcagtgaaaatactctgtgtatgataccataatggtggatacctgtcatgacacatttgtctaaatccatagaatgaataataccagcagcaaactctaatgtaaacatggattttgggtgataatgatgtgccaatgtaggtccaacaatagtaataaatgctcccgtgggagaatgtttataatgggggggctatgtatgtgtaggggggaagggctagttgggaactctgcacattcctctcacttttgtggcaaacttaaaactgctctaaaaaaaagtaaagtatttacaaagtcatttttgataaagtatttttttctgcccccacttattgacagactttccttgagaatccccacctgtgccctgtacccacttccctctcagcactaggcaccctccaaggtccctgctcatttgcatattttcttaccacaccagcatgtgagtccttcatcagcaggatcagtatctcccaggacctaatatgtgactggcacatagtgggtctgctgtggctattggtggaggtgatgttccctggtgggctggggaggctccacaggagaaggaaaggctgagctccttttctttcttcttccttattttggcttccttcctctgccctgcgtttggaaacctgttttgtttgtttgtttagaaagcttggctagtaattcactagtccaatcaggctgtagggtagaggatggagtggctcatttcatgtcttttgttcttgaaaaaattaggggtgagtgggaaagagaatgagagaatgaacggaaggaggaggggccgtgtccagttgctgttttcagggagactcatcttattaaaattttgctgtgtcatcaactggcccaactggtttttagggtcaaggagaaagttttcctttgggactggacaggtggaatctggcctcacagtttctacaacatatggcaggatcctgctcttctgtcccctgtagcgggttgtcccgtgttccccttaaggaagaaatcacagtttttgtcctcctggtgcttccggctggaggttcacctgctagtccctgatcctctttgcttagtgatgcacatgagtctactcatccccccaccactcccagcccccactggtctaggcaaaatgcaagtgatgggagagtgtgggtgggcaattctttctctggagggtttaggtgggtacctcaaaacagcaggcagctaggacttgaagtggtggcttcgcagctaacattttccttgttccacatgatgggtaggggtagggtagggaagacttcactgtttggagtttcggaggatgcccctctttctctttatccttcctccccacagtcccctcccatctcctcccttatacctcttttttttttttttttttttttttgagatggagtttcgctcttgttgcctgggctggagtacagtggcgccatctcggctcactgcaacctccatctcccaggttcaagcaattctcctgcctcagcctcctgagtagctgggattacaggcatgcgccaccacgcccagctaattttgtatttttagtagagacggggtttctccatgttggtcaggcttgtctcaaactcctgacctgaggtgatccacctgcctcggcctccgaaattgctgggattacaggtgtaagccaccacgcccagcccttatacctccttttaagcaatgtcctcaccccaaatccatctcagaaaattgtccctacccatatggtcagaagtccttcaagactcctggaaaagaaatcacaactacttttaaatcaaacgtctgactaattttggaacagtgagaacaggggctggttttagtcatctttggatcaggtgcccaatacaagtttgttgaatgaatgcctgactggtcaagacaaaatcagtctttcaaacagaagctagaaatcaaaggttgcctatagccccattcctctgtccatcctccccatctgttgagatggcacgatttcagaaaaacatccctcccactggtcaatcctttgaaagcttaattattcagagttctaaatgacccctttaagggttgatcatataatgctttgacccgttggactgtgccagtagaggaggagatgttctgtgttccccgagcctcttcatccaagaattccaaagtgactcctcctgccttgatccctcccaatggccctctcctcctcatagcccatggggacctcttgctggggcgtgacgctgcccacggaggggtggaattgcttcttctttttttttttttagatgaagtctctctgtcgcccaggctagagtgcagtggtgcaatcttggctcactgtaacctccgcctcctgggttcaagtgattctcctgcctcagcctcccgagtagttgggattacaggcacctgccactgcgcccagctaatttttgtatttttagaagagacagggtttcaccatcttggccaggctggtctcgaactcctgacctcaagatccacccgcctcggcctcccaaagtgctggaattacaggcatgagccaccggaattgcttcttaatgcagaatgtgtgtgcaagactgtgaaacagcaagagttggggagaaagcgtaggtttctgtgtgcatggtacctttaggactggctgtgtgtccacccacaagccagcgaaggaggtgggaacctgggattctgtttacccagccaccaacaagccccgttgcctttctggcacacacaagcccaatcacccagaactcctgaaaatataaatgttctcaagatctcatgtgggagctttttagctgagaccagccacacatgcaggagactggaagcactatttcccaggggtggaacaacctgctcagactcacttttagattggaggatacccatctcagcgtggattctcccaagaacagatcttaagacaagggcttggatgtaggtaatttacttgggaggtgattccaggaaataagagtgaagaaatggggaaagcaagctgtgaaagggagagaagccaacagtaaggtatgctgatgggccagttactgccatgggcaactgaggctcagtctggcttggcgtccactgagaaaccttgtagaacagccctcagcattgtctgcctggatgaccaggaggccagagtatttctccactgacttcagtgtcttggttgcttttcttttctttttttttttgagacggagtttcgctcttgttgcccaggcaggagtgcagtggcatgatctcagctcactgcaacctccgcctcccgggttcaagagattctcctgcctcagcctctcaggtagctgggattacaggcatgcgccaccatgcctggctaattttgtatttttttagtagagacggggtttctccatgttggtcaggctggtcttgaactcccgacctcacgtgatccacctgccttggcctcccaaagtgctgggattacaggcatgagccaccgcgcctggccctcttttcttttcttttctttttttgagacagagtctcactcttgtcacccaggctggagtgcagtggcgccatctagactcattgcaacctctgcctcctggttgttcaagtgattcttgtgcctcagcctcctgaatagttgggattacaggcgtgtgccaccatgcccagctaaattttgtattcttagtagagacagggttttgccatgttggccaggctggtctcaaaatcctggccttgagtgatctgcccagctcagcctcccagagggtactttcaagttacatctatggaacaaagcaagccgctctgctaagctcctccagttattgattacacaacccccacagctgtgaccaccatttggctaccaccatcatcacagcttctgcccctccaatttcccccagccaattatatcactgccttttctctctgctaggttctgttaggcctgagctttaaagagaaaggaataaagtggaatgatatatctttgcccataactcattctaggaaaaaggaactatgctggttttctttttcctccatttcaacctatccaatctacccaaatagttcccaatcattatcacctcatcccaaagcaacagacgggaaagaggaacagggcaagaaagcagacaggctttctggagtgacttttatccccacagagtcatagatgcagagttggaagagatgaattctctcatttgggagataaggacaccatgcagataaagagactctgtatcttctgcttttcctgctgctgcagtgcttcctccaggcaggcttccttagtttttcttggcttcctacccttccaacctacgccatcataatctggactccagccctttattccctcaaaggctgactcaggccatgactgagggaagaagcttggattctgtagtggaacagcattgtccatggggagacacggcttccatcccaggcctttggttccattacttagtttctcacttgcctgtctgtcatccaaaggggctcacaaggaggggaatgcagggaggagacatctccctaataccattggagtttttttccaggttaagatggtgcattgaatccacccatctacttttgctcctcccaaaactcactaaaactattataaagggattttgtttaaagacacaaactcatgaggacagagagaacagagtagacaatagtgggggaaaaataagttggaagatagaaaacagatgggtgagtggtaatcgactcagcagccccaagaaagctgaaacccagggaaagttaagagtagccctattttcatggcaaaatccaagggggggtggggaaagaaagaaaaacagaaaaaaaaatgggaattggcagtcctagatatctctggtactgggcaagccaaagaatcaggataactgggtgaaaggtgattgggaagcagttaaaatcttagttcccctcttccactctccgagcagcaggtttctctctctcatcaggcagagggctggagatttcacctccggagagagtaaaaaggaggatctctgggctggggcaccaggcgtggctgaggacaaaggtggcatgtggagaacaggggcgttaagtgactatttcctcactgcatgctgagaacctcagctttcttctctgatcacttcccaaatcactggcagctactctccacctctcttctctgagcactctgaccagccaaaagggaaagaatgaaggatactggcattcagatttccagtaaacgaccatccatgtctccctacggtgaatcacagttgacaagcccagttcctgcactcagggtttttcatagtcctttactcttaatcaagagcagagagctaaagattatgtcttaggttccctagaaacagaagctgtgatgcagattcagatgcatgcgatttattgcgggcgggccctcagaagaagctcctttttccacctccagaaagagcatggaaaggaactgagcaaggatgtggtcttggctggagtctagcctcagtctgacccacagggagccctggagcatgaattgcaccacagggttgatctcaccttgaagcaagagggccagcttttgtatccatatattgatcaatcactggctgtgggctgccagggaggaagccatgaattcccaggcaaggtagttcctacttgaggacaattctttagataaagtggcagctctggtctatttatgaccgagatttatagcagctgaaggtatgggcagaacaccaataacatctactgtagattaccagattaccaaatatctgaggaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaacatctgaataacaagcatttcagaaaaggagggaaggaaatcatcaatgtgataattcaagaaaaatttcccaaattgaaaaacataaattgccaggtcaaaagggctcaccgtttgcctagtttaaccaaggcacataattgtgaaatttcacagccctaaggataaagagatgattccacaagcttgaacaaataaaagaataagtcatatactaagtcttaagaatcagcatggctccagacttctcttcactggaattgttccagcaacactggaaggtagaatactagagtaatatcttcaaaattctgaagaaaaattgtttccaatctagaattctatatacagtgaaacaatcaagaaatgagtggaatgaagacaatttcagatatgcacatcccatgtttccttttctgggaagtaatttaaggatgtgctccaccaaaccaagggagtaacccaaagaaaaagacacaacatgtgggaaatgggagatccaacacaggggagagggatgaggaatccctatgaggctgagatgatgaaacttggaggattggagcagagagactcaagagatagatatgttaaagactgtcatcaccaaagtgactactgtcatattgccatctttatagccactttttgttagaagcacagacttttgaggtaaattagataaaggacagagatcccacatactgttggaaagaggactggcctaatactgttgaggcttgggttctagtcctgacttactcttgaagtaggtataagatctgggtatgtcatttttcctccctggatctcaggattatcctctctacatgtcaaggataggctaagtgaattacatgtatttttaaggctattgtgccttagtgacatgtattcttcatggcactgtatacggttatatggcttttgaaaatgcagagtcatgtaactacctccacagtcatgctacagaacagttgcatcaccccccaaaaatctctcatagctcccctttgcagtcagcctcttgcctcccccttaaccctgtcaaccactgaccttttctccctccctatagtcttaccttttctagaacgttagataaatgcagtcatacagtatgaagcctttcagatctggtttctttcatttaacacagtgcatttagttttatgcactaaccagcaattaccactgatcttgttttcagttctctcccaaagcagatgctaagacaagaattcaagtgcaagtagtttatgtgggaggtgatctcaggaagcaccagttagcggagtgagacagggaagggaaagaagccaatacaggatatgtcagcaagcaagctaccactgtgggaaacaagctcaccctgctggagactctgggatccagtgcagagcacacatctcagctctatccagcccaaggagcgaaaaagctgggatttttatctaccaactccctgtccatcagtggttgagtgctacttcttagggccttcactctccagcacttctggcttgccctgtgcacagaccaagcatgttcctgtgactagaaataaaagcccccaggcagaaagcaacagatgttcacattaagcagctttccatgtgcaggggcgaatgccaagggtgatgtgtaagacactggcagcgtcagctgcttccaacccaacccaaatatttttattgttgtatgtgaagggaagcaaatatatactataaattcttaaattcattctgctggataaagagagaaaagtcctggatttcttctcaataggccaattttaaaggctacttttcatatataggatgggcaaagcacttttaaaaacatttatcttagattttcactgtatttatggtttacaagggtgctttgcatgtaaaacttaatgtttaaatagcacaagctcatacagtccatattcaatccctcgattattaatacaaaactcaattcaagcaaagacaaaggatataacagaagctaaatccaacttgtgaataatgagaataattgatttgtttaggttctattattcagaaagttatgtctttgtttttttttttttttttttttttccaggcagggtcttgccctgtagcccaagttggagagcagtggcacaattatggctcactgcagccttgacctccagggctcaaggatccccatgtagctgggaccagaggcacacgccaccatgcctggctaattttggtattattttttgtagagatggggttttgccatgttgcccaggctggtctcaaactcctgggctcatgcaatccacctgccttggcctcccaaagtgctgggattacatgcgtgagccactgcgcccagccagaatgttatgttttaaatttatctgtgttatcagttgggtctctttgcttctttaaagaaaatttaatatttaaattaactttttttttttgagatggagtcttgctctgttgcccaggctggagcgcagtggcgcgatcttggctcacagcaacctttgcctcctgggttcaagcaattctcctgcctcagcctcccgagtagctgggattacaggcatatgccaccatgcctggctaatttttgtattttcagtagagacggggtttcgccatgttggccaggctggtctcgaactcctgatctcaggtgacccacccacctcggcttcccaaagtgttgggattacaggcatgagccactgcgccctgcgattaacttattttttatacatctaaaatgtacaagtgcagttttgttacatggatatattgcatggtggtaaagcttttagtttaccactgagatgtattctttgtatcctgtctctggcagtcagctcacagtgtattctttgtatcctgtctctggcagtcagctcacagaaatcctcgctggctccagccacacccaggattgtgtgattccttgggggctggctgccgctcctgtgtgcctcttgacgcccagtgtattccaaggtcctgtgctgggccaggggaacttagtagattatctaaggcacttctttatttttgggttattctcaggtgtgcacaactcattcttttacttccacactttgctggctcttggcagccctggcaaggctgtctcaacctgcctcatgtgcacacagctatctctatttgggagtctaactgccaccctaagctctatccagggttctcactgtacttacatcccccaaacctgaatgggtttcttccttctttccttccttccttccttccttccttccttccttccttcctctctttctctctctccttccttccttctccctctctctttctctcatctctctccttctctctttccccctccctccctccctccctcccttccttccttctccctctctcatctctctgtctttctctcttcttctgtctttcccttcctcccctcccctccctctctccctccctccctccttcctcctcccttccttcctcctcccttcctccctccctccctcccttccttcttttcaagacagagttgcccaggctggagcgcagtagcacaatcttgactcactgcaacctctgcctcccaggttcaagcaattctcctgcttcagcctcctgagtagctgggattacaggtgtccactaccatgcctggctactttttgtatttttttgtagagatggggatttcaccatgttagtcaggctggtctcaaactcctgacctcaagttatctgcccacctcagcctcccaaagtgctgctgggattacaggcatgagccaccacacccggcccaagctcttttccttagacatccaccatcatgtgactctccttactactgagtttggggatttattctgtatatgtgggtgaatgcttgctctcaaatgcattctttcaaatccgttatattgtctacacctatattcctctaggtttctttctaatgaactttctttaaaatttacttttaattttgagacaatggtagattcacatgaagttataagaaataatacagaacaattctgtatagccttcacccagtttcccccaatggtaacatcttgcataactataccatagtatcatagccaggagattgacactgataacgtcaatcttattccattttccctagttttataggacttgtgtgtatgcatgtatttaattctatgcaattatcatatgtatagattcgtgtaatcaccaccatagttgagataaaaaatagttcaatcaccacaaggatcttttgtgatgtcctttaatttatttatatttatttatttatttatttttctgagacggagtctcgctctgtcgcccaggctggggtgcggtggcatggtcttggctcactgcaacctctgcctcccaggttcaagcgattctcctgccttggccccccaagtagctgggactacagccacgtgccaccacaccccgctgattttttgtatttttagtagagacggggtttcgccatgttggccaggctggtctcaaacccctgacctcgtgatctgcccacctcagcctcccaaagtgctgggataacaggcgcgagccactgcgcccagccttgcccttttataatcacacctgcatcctccctcccgacccgccttttccctaactggcaactatgaatgagggttctccatctgtataattttgtcctttcaaaatattatataaatgaaatcatgctgtatgcaacctttgagaactggctttgtttactcagcatactacttccctggagattcatccaaattgttgcacgaatcagtagtttgttcctttttattgctgagtagtattacagggtatggatgttccacagtttgtttaaccattcaccttttgaagagtatctggatcatgtccagttttaagtgttacaaagagtcaacacaataagatagtgatgaacatttgtatatgggtttttgtgtgaatataatttctctgggataaatgtccacgagtgcaattgctaagtcacatggaagttgcatgtttagttttgtaagaaactaccaaattgttttccagagtggctgtgccattttacattgccaccagcaatgtatgagtgatctggtttctctgcattctcaccagcatttgttattgtcataactttttattttagctattctgataggtgtgtagtaataactgattgtagtttttactttgcatttctcacgtaattactgatggtgaactttttttttcttatctctatttgccatctgtatattctatttagtgaaatggctggtcatatcttttgcctattttctaagtggattatttgtgggattttttttccccttgagttttgagagctctgtatgtattctagataatagttctttgttaaacatgtggtttgcaaatattttctttcagtctgtggcttgtcttttcatcagcttaaagggtctttcacagagtaaaagttttgatgaagtttaaattatccaattttccttttgtggattgcacttttgctgttaatcctaagaactctttgcttagccctagatcctgaagattttcccctaagttgtttcctaaaatgtttgcatttatatttaagttcatgtttcattttgagttaatttttgtataagttgtcacgttttggttggagttcactgttttgttttgcccttggatgtccaattgttacagtacaatttgttgaaaaggctatccttccttcactggattgcttttgcacctttgtcaaaaatccgttggcactgggcagggggctcacacctgtaattctagcactttgggaggtcaagacatgaagatctcttcagctcaggggtttcagaccagcctgtgtaacacagtgagacctcacctctataaaaaataaacaaaattagccaggtgtggtggtgtgtgcctgtagtcccagctactcaggaggctgaggtgggaagatcgcttaagccaagcaggtcaaggatacggtgagccatggtcatgccactgcactccagactgggcaacagagttagaccctgtctcaaaaaaaaaaaattgtaaaaaaatcagttggcttatttgtgtggatctatttctggattctctattccgttccattgatctgtgtgtctatccctttgccaatattgcacagtcttgattactgtagctatataataactcttgaaattcctcttactttattcttattttacgtaattgctatatctattctagggtccatgccttttaatataaattttagaataaattagcctgtgtctataaaaaccctttctgggggttttgataggaattgtattaaacttggagataaatcttgggaaaacttatatctttattatgttgactcttccaaaatgtaaacaaggtatgtttagccatttatttagatctttaatttcttttaccagcatttgcgatttttatcatacagatcctatatatgttttgttagatttgttcctaggtttttctttttttttttttgagtgattgaaaacgttattgggttttaaatttcagtttctgtatgttcaatgccagcatataaaactgtatgctgatgttgtgcgttgtgaataaactcatttattagttctaagaggtttttttggtgggaattttcttgaaattttcaatgtagatcctcatatcttctgcaaataatgacagtttcatttcttcctttataacctgtatgcattttttcatgtcttactgcactggctagaatttccactaatatgttgagtaagagtggttagagcagacatccttgctttgttcctgattttaggtggaacgcattcagtctttcaccaatatgtatgatgttagttataggttttgtagatgcttttttaatcacattgagatagttcccctgtattcctaacttgctgagtttttaaaaatcgtaaatgagctccctctccctcccccgcccccctctgatgccgagccaaagctggacggtactgctgccatctcggctcactgcaacctccctgcctgattctcctgcctcagcctgccgagtgcctgcgattgcaggcgcgcgccgccacgcctgactggttttcggtttttttttggtggagacggggtttcgctgtgttggccgggctgctctccagctcctaaccgcgagtgatccgccagcctcggcctcccgaggtgccgggattgcagatgaagtctcgttcactcagtgctcagtggtgtccaggctggagtgcagcggcgtgatctcggctcgctacaaccacctcccagccgcctgccttggcctcccaaagagccgagattgcagcctctgcccggccgccaccccgtctgggaagtgaggagcgtctctgcttggccacccatcgtctgggatatgaggagcccctctgcctggctgcccagtctggaaagtgaggagcgtctctgcccggccgccatcccatctaggaagcgaggagcgtctctgcccggccgccatcccatctaggaagcgaggagcgcctcttcccggctgccatcccatctaggaactgaggagcgtctctgcccggccgcccatcgtctgagatgtggggagcacctctgccccaccgccctgtctgggatgtgaggagcgcctctgctgggccgcaaccctgtctgggaggtgaggagcgtctctgccccgccgctccgtctgagaagtgaggaaaccctctgcctggcaaccgccccgtctgagaagtgaggagcccctccgtccggcaaccaccccgtctgggaagtgaggagcgtctccgcccggcagccaccccgtccgggagggaggtgggggggggggtcggccagccgcccagtccgggagggaggtgggggggtcagccccccgcccggccggccgccccgtccgggaggtgaggggcgcctatgcccggccgcccctaatgggaagtgaggacccctctgcccggccagccgccccgtccgggagggaggtgggggggacagccccccgcccggccagccgccctatccaggaggtgaggggcgcctctgcccggccgcccctactgggaagtgaggagcccctctgcttggccagccgccccgtccgggagggtagtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatggaagtagacatgggagacttttcattttgttctgtactaagagaaattcttctgccttgggatcctgttgatctgtgaccttatccccaaccctgtgctctctgaagcatgtgctgtgtccactcagggttaaatggattgggggcggtgcaggatgtgctttgttaaacagatgctttgttaaacagatgcagcgtgctggttgagagtcatcaccactccctaatcttaagtacccagggacacagacactgcggagggccgcggggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaaaaaaagaaaaaggggcccaggggacaggcattcagcatatggaggatccacgccagccccggctgctgcgttcccttagtatttattgctcattatcgggcgtgacaggataataggataatggtggggaggtcagaaggtaaacacgtgaacaaatgtctctgcaccataaacaaggtaaagaaaaaagtgctgtgcttttgatgtgcatatacataaacatctcattgccttaaggaacagtattgctgccagcatgtcccacctccagccctaaggcggttttctcctatctcagtagatggaatatacaatcagctttacacccagacattccattgcccagggatgagcaggagacagaagccttcctcttatctcaactgcaaaaaggcgttccttcctcttttactaatcctcctcagcacagaccttttacgggtgtcgggtgtcgggctgggggacggtcaggtctttcccttcccacaaggccatatttcagactctcacatggggagaaaccttggacggtgcctggctttcctgggcagaggtccctgcggccttctgcagtgttttgtgtctctgggtacttgagattggggagtggtttgagattggggagtggtgatgactcttaacaagcatgctgccttcaagcatttgtttaacaaagcacaccctgcacagcccttgatccatttggccctgagttgacacagcgcatgtttcggggagcacagggttgggggaagggttacagattggcagcatctcagggcagaagaatttttcttagtagggaacaaaatggagtctcctatgtctacttctttctacacagacacagtaacaatctgatctctctttcttttccccacaatgtggttttgggcgactgtagtcccggctacttgggagactgaggcaggagaattgcttgaacctgggaggcagaggttgctgtgagccgagattgtgccactgcactacagcctgggcgaaaaaagcaaaactccgtctcaaaaaaaaaaaacaaaacacttgtgatttgggggttttgtggaaatttaattacgatgaaaaatctgtatcttttttgtaatgttggcatacttgggtaattttgtggcaaatatatttcccagtggaccttttgttggtggcactaactgcaaggttgctgggaaagtggagtctgtttggtggatgagctctgactgccgttttggaacctcacctctactcatgctgtctcaagtccttgtctcattctccagctctcagttcaaataaagttatttctcctgggaaaaaaagttccgtgaaacgcacactggatgacagtgctgaagttgggtgccctgggaagtcctcaggacacccctgcatgaaggctgccccaggagagcagcgcaaggttgtggaggtctcaaagctctgaagaacctgcctaccgaagacaggagtgcccacaaaacagttggcccatgggctccccaagacctacgtgtacctcggaggcatttggcagaagattctttgtgaacaaaaatctctgcccactaggaggcaggagtgtgtgtgtgtgtgtgtgtgtgtgtgtgtgttgaaaccagaactccaccttatgtgttcattgtggaatttgaaaatggaagcctaaagttgaaaattaaaatcacccgtgatagctgtaaaaaaaaaaaaaaaaaaaaaaaaaatcgtaaatgagttcttactttggaagcatatatactaaagttggaatgaaacagagaagattagttactgatttcatttttcaataagtttagatttattatgttggtttcccaatttaaaaaattgacttcttaaaaaatcataaatgagtgttggattttgtgaaatgctttattctgtatcaattgatatgattataggattattattttttagcctattgatatagcactgtaataaaagttatgtgaatatcctctctctctgtctctctcaaaatatcttactttggctgggagcagtggctcacacctgtaatcccagcattttggaaggccgaggcaggtggactgctttgagctcaggagttcaagaccagcctgggcaacttgctggttgcccagcaaacttgtttctacaaaaaatacaaaaaaaaaaaaaattagctgggcaatcatgcctgtagtcccagctacttgggaagctgaggctggaggccagttcctgagaagtcttttctttcctccatctcttctcttggtctctgtgttgtgctaagtcaaggatagcttcctcctttgacagattatctttgactttgcccatcaggtgagagggcactatcagccacaggaccactctctcgtttactcatcggggagatgttctgctccctgtggtgtgggtgtggacgctttactctggaatcccttccagtggacgttaagcatccccctcagggcttggagaggaccaatgaacaagggaagcagggcaggcaaagagtctgaggcaggcggctgatgaaccaggtcttcccctgagtgatgctgggaaaagaagcacgttgactaagcacctgtgatgtgccatacactttcatatgtgttaattaatcccgtagtgaccctgtgaggtaggtataatgatcatccccatttacaaatgaggaaactgcagtgtaaaagaatttaaaactaggtttaaaaatgagggaaatagaaaagcaccattaggcaaacctatagtaataatggttgcagtaagattcactgatagttgctaaaagtatttttattaattataaaggaaaaaatggctgggtgtagtggcttatgcctgtaattctagcacatggggaggctgagatgggaggattgcttgagatcaggagtttgagaccagcctggtcaatagagtgagacttcatctctattgttataaagaataaaacaaaatttaaaataaataaattttaaaaacgttttaagaaggaaaaaatataaaagtggagaaatccggtaaataccaccctaatcaagtgatcaaggttagtattactagtaataattgatactgacattaggtactccctgatgtgatgccttgagttgagcacagtatcatctcttacatcaatctcatcatgataaaacactagacaaacccagactgagatggggttccacagactcctactcaggtgtcagaattagaacccagagcccatcatctttccactctgggcaggaaaggtatggaggccaagggtagggggatgcctcctttctggagggaggcactgctgactgaacgtgtacccacctcagtacgtgggactcatgactacagtgtgctctgtaactagaaactacatctctttgcctgagggcattctccaaagcacaaaggtggttctgtctgtgctggccttcccactcctttttttttttttttttttgagatggagtcttgctctgtcgcccaggctggagtgcagtggcatgatctcggctcactgcaacctccgcctcccgggttcaagtgattcccctgcctcatcctcccgagtagctggggactacaggcatgtgccacaatgcccgactaatttttgtattttttggcggagactgggtttcaccatgttgcccaggttggtcttgaactgacctcaagtgatccgcccgccttggctggtattacaggctcttgagattcttaaacacatcacatcataaagtcccttgtgccatgtgaggtaatatactcacagcttctggagattaggatgtgggcatcttgaagggtatcattattctgtccaccacatgcccatggtccagggttcagaataaaaggggctctgagttggcaacatctgcccagaggaagccagtgctgtgagaaggggaaggtggtacaaggggctataaactaaaatgcagaaatacagaggaagacatatttcagtggttacatagcatgtggtgtgtgtatgcgtgactgtgtgtgtttgtgtgcatgtgcgtgtgtgtctgggggaaggaggtagaggaagtgagatgatggtgacagtgacagcagcttggagaagacaggggggtgggtctacttctgaggaagtccttggctgaggtagggccgcagagaggcagggtgagggtggagcctgtggtttcagagaggagttttaatggctgccaagaatgtgcacatgaagccgaaagggagtgcggcctggagctgcagtcagcccagagggcgggtggagcctgtcccagggcactaggatcgcagagaacgacaggagggagcagggctctgtgagcagggagaggaaaaagagagaaactaggtttgtgatggaaaatgggctatggtttcataattggaagtgcctgtgggcaatgagtataaatggagggtttggtaacacttggggaaaaattattaatttggaacttctataaagccttttgtctcctattaaaaatcctgtgggtaccaagtgaatttcatcatttaattctctcaataaacaatgaactgctactttgcatgggacaacattctctggagatgcatacagtgaacaaacaaggtgaatgaatggactcagggaattaggtgtcacaggcatagaaaggcaaggagatgaaggagtaagtcagcaagaggatgatggaggcagaatcagctttccccagcaggggatgacacggggttttcgatatcacctgcccggggaggcttgcccatttccactctccagcccacctgcccaggggataggctttgaaatgtatattccctactgtccgcctccttggagccattccttcatttcttccttcctcctcttcctctccccttgtcttcctttgccttggagcttgggaggctccaggcaagaagagggggactgcggcatctttctcttgcttccctctcttctttctaccctttggatcccattcaaaacagataaatagaggtccactgtgggcctggaatcatgcaggggttacaagacgggggactcccatgaccaagcgtgattctccagcaaggggatttctgggagcccttagcagctgacacatgcagcagctgggccaggggtggaccagcctgttaaggggatctgtgtggggcaccagtatcctctactatagcaaggatgtggagtagcagataatctcacaccctgctatagattggaataaaactttagaaagcaatttgctaatattgtatagagaggaagacacacatggcctgtgacccagcaattccacttccagtcacatacccaagagaaactttgcatgtgcatgaggagacaaggaatgttcattgcagcataatttgaaaaaacaaaagctggaaataaatgaaatgtgcatcttataggaagttggatctattcacgtaatggaatacagcaggtaaaataaacaagatttatgagtatcatcagagataactctaaaagcatgatgttgagtgaaaaaagcatgctaccaaatgatatatataatgttgccatttatttatgtattatttatttatttatttttgagactgagtcttgctctgtcgcccaggctggagtgcagtggcatgatctcggctcactgcaatctccgcctcccaggttcaagtgattctcctgcctcagcctcctaagtagctgggactacaggcgtgcaccaccatgcccggctaatttttgtatttttagtagagacagggtttcactatgttggccaggctggtcttaaactcccgacctcaagtgatcaacctgccttggccccctaagctgctggattacaagcttgagccaccgtgccgggcctaatgttgccatttatataaagtttaaagacacgcaaaacaatacgtttacatatatatgtgtatatatgtatatatgcatttatgtatgtatatatctgtgtatatatagtaaacatatatgtatgtaacatagtaaacatatatacacacatacacaaacacacacatatatagtaaaagtgtaacagcatgcttgggaatgctaatactcaatatagagtagtgggacttgcagccagattgcttggatttgcatcctagttccttttcttactagctgtataatcttggagaagttatttaacctctgcaggcctcagcttgcttatgtgttaaatgggaaatgccaattgtatcagccagcaattgctgccctaatgctgtgtaacaaacaacccctaagctcagtggctttcaaccacaagcagttattttctatccacaagcctgtgagttggctgtggctctgctggactgggctccaggaagtggcttaggttcatgtctgctccacgtgtctccaccagcaactatccagggcttgttcttttcagggcagaggtcacatgcatgggtggctgctgaaagcacatgatgccttcttgagtctttggcccagaactggcatattgcttccacccacattccagtggggtagggaaagtatacaccacccacagtgatccagagcaagggcagcaggagaaggaggtactgggagcaagtaatggtgcaatagtgcctacctgctttgtttgaagcattaaatgagttaatgtgtgtcaggtgcctggcacatagtaggtgctatattcttactaatcaggagaatgatgaactctgggagaaagaggaaatttaacttatccattaaatttcttttttaaaaacaaagatcataaaaagaaaaagagggaaaaatatttgctttcagaagagaaagcgagagagagagagaggacacgaatgctgcagactgaaccacagggagcattggcattcaggaaaaagaggaaaatggaagacttaattgtagactccaggaggcagggactgtgtgtggcctcactcatttctctgtccccagcaccatgtctgacacatggtaaatgctcctaaggagcacagggaaagaagaaacaatgatagaggcagaggttggagagaatctgagaaaaatgagaagctctcaccctaaaagctagaggagatcgttaaaaggggctggatagctgccttgtggactggtcagcagtggccatcatcccactctggacccagcctcactgttgggtctggtgttccaggacacaggggacagacttgctatttcatttggtgagttttgtctcaggccaagcttctgagtagtaggaggtgaaaggcccagtcccccgctattgatctcttaatttcagcatcctcttctctcccttttccctttggctgtccctgattctccttttcaaatctccttccagcctcccactcctcgggtccccactgcctggaggaatatgcagaggccaagacagaaaggaggctgggcacggaggctcacacctgtaatcccagcactttgggaggccaaggcaggcagatcacttgagcccaggagttcaagaccagccttagcaacatggcaaaaccctgtctctactaaaaatatagaaactaaccgctgtgatggcacgcacctgtacctgggaggctggcttgagccctggaggtgaggctgcagtaagctgtgatcgcaccactgcactccagtctgggaggtggactgacgagtgttgggggctctcagagaccaggaggggggccaggatagagcccttcttctttgttttcctactttggcctgaaaagctccactgagccttcatgaagggcaggcagccaaaggctggggagaaggtggactcatttccttgtaaattacgtggttatgagggcgggaatttcacatgtggctttttgcataatcaggttatcaggtagttggcccattcctgggctcataaagtctctggttgctctgactcatagcatggagtgggaggcgagccagcagggatggggctgggaggaggtgcccgccagctgcctgcttgggtggtgtcaggtggggatccttttcagagcccaagtgtcataaacatctgggcttgagaatcggtctacttgagttcaagtcttggcctcaccgcttgccagctgtgtgaccttgggcaagttcctaaccctccctagtcctttatttctgcattagggcaagggtggtggtttagagaaggatttgcctgggaaagagcaggtggctgcttaagcagatccccaggagggcagtatgtgggtgtggccaccaacctcctgaatccaatccacagatttccctgaaaaaatgtagtggtttgcactctggcaaaccgtggggcaatatctaataaactcactgcattaattttctagggctgccatgacaaagtaccatacactgggtggacagaaacaacagatatttatcctcccgcagttcaggaagctagaagtctgagatcaaggtgttggcagaaccgggctctaagagagaatctattccatgctctttttttttttttttttttttcctgagacagagtcttgctctgttgcccaggttggagtgcaatggcacaatctcagctcactgcaacctccacctcctgggttcaagcgattctcttgcttcatgctcccaagtagctgggattacaggcgtctgtcaccacacccagctaatttttttttgtatttttagtagagatggggtttcatcgtgttggccaggctggtctcaaactcctgaactcaggtgatctgtctgcctcagcctcccaaagtgctgggattacaggcatgacccactgcacctggcctattctgtgcttttctctgagtttctggagtggcgttccttggcttgcggcagcatcactccaagctctgcctttgttgtcatgtggcatgctccttgcgtgtctctgtctcacgtggctctctcttctgtgtgtgtctgggtccaatttccttcttataaggacaccaatcatattggattacagtccaccctaatgaccttctcttcatttgattatatctgtcaagaccctgtttccaaggaaagtcatgtttgtaggtatcagggattaagtcttcaacatatctttttgggggacatgattcaacccatatcacccactttacctacgaacagtaggactgaaaggcccagtcccctcctgtccacctcacaattccatcaactcctctcctaggaatataacttaaagaaattagtggttagtctactgaaagctgaaacgcatgtactagaatgtttcaagcatctttatttttaatagtcccaaactggacacaactctaaggtcccatccacaggagaattgacaaacagattagagtacattcacacaatggaacactactcggcaacagaaaggataaattgctgatacaagcaataatatgaatgaaagactacctttgtttggccctggctatttgtagtcctactatgtgacactattttatgaaattcaagaagagacaaaactagtctgatagatgtcagacataaataaaaatttattgagctgtacacttaagctatgtaaattatatttcaatttaaggagtttaaaaaaattaaaaaaatttaggccttggcatgcccagaagtcaatgacttactcccagggcttgactcccatttgccaaagttctaggagcttgatgtataaactggaaagttgacaagataagtcctaatgagaactctaatgagccaggggcccagtgcctgtgtcacctggatagtggcagagacaaactgtccaatgagatactcaggacaccctcttctgaggtgctgctggttgattatgccccttccttggactggatgccacataatgagctgggttctgacttcaccagtgaagtgtcctgtgtccttgtggaaatgactcagcccccttcctcatctctaaaatgcgtatacctaccctccctcccagggtggttgtgagaagcatttgacaaaacaccatatttaaagtcccattcataggaggtaggtactcaggtaatgtggtttccccttcctttcacagagctgggatgcagctactggctcagacatttttcttttgatccttttgggtgcagagccttttgctagtagccaaaagaggtgacgagacactcctgagaacttccttgtttctcaggtcacatagataatagataataacttatatcggcaaagctatttaaaaaacactaggaagctcacagcctaagaatatatcctccaccagccaactacctggagtcccctctaagtgtgtcttcctgtggggtcactattgccccctgtctaatgtgctgactttgtgagtgcgagggtggggcataatggtgcatttgttagtcctggtggtggatggaagggttgggagccctcattgcaggaagaaaggacagaatattttggagctgagctcattgagggggagatatttgagggtgctcacattccccctgttcccctgagatggccctgagtcctcagcaccctggtgagattaccgggagtaggcaggagtggtgagctctggcaactgccgcccttttgggtcttccctccatccccgggacccacccttctgtgtccctaccatcttaggctaggacaggaaggctgcagagagatagggctggtggggactggtgggcagtgcctgggtacaaggtacgttcctgaaggggctatttggagagcaaactccccaggtggatgccaggctacactggcagagtggggatctattttgattcccaagaattcaactttagaacaagtagtgaatgaggggattacgaacttcctacaagcatagttggatggtgcataggaacatgcccttgggccaatgtcatgagccctgggctacccacctcttggtgttctttccctctgtattagatttccccagagaagcagaaccagtagaataaatacataatgagagagagagagactaattttaaggaattgcttcatacaactatggaagccagcaagtccaaaatctgcagagtaggctggcaagctggagacccagggaagagccgatgttgcagatccagtctgaaaaaccctctgcaggtagaactctctcttgctcagggtggggatgagggtaggtcagccttgctctattcaggccttcagctgattggatgaggcccacccacattatggagggcaatctgccttactcaaactctactgatttaaatgttaatctcatcaaaacagcctcagagaaaaatccagaataatgtttgatcaaatatctgggctctgtggcccagccaagttgatacataaaactaacctccttattaaaacgacttcgccaagcagtacgaacagtagctccctgaggccctgccttgtgttgggggccttgtgctttgcctgattcaggtggaccctcccaacacatctgtttggtaagtgtcatgcttgtttcacagacgagttaactgaatcttacgcgatgtgacaggtgatgttggtgccctatctagatcccttttcccagctagtgtccccctccccagctggtgacggtgcagtggctaacaacttacatctgagaactttcatggaggattccgctggcaatgggattgtccttgtccaggacctagtgactcatgttcccttctcccatcatccagggatggacaacgactgactgacacaagggtacaaaagcctgtcctgcttatctcagggggcaattctgtggacagcttacacccagagctcccggtggattgggctgaggccaggctggactgaggccacgcccctgctgaacatcttcctctgccacatcctgcttccctccatccctttctcctgagatcatttcctccataaatcacagggattccacaaatcctcatcctgggctctgagtctaaagaataggacctaagacacctgtgagtgaggaatgtaaacccaggtctagctgccttcaaaggtgtcccacaggatcttcgcattgtccgtagctgacaggggtgaggacctccctggggaggggttcctggttgcagagagggaagactccccgccttttggaaggtctcttgggtttgcccccttccttctttgcttgcccacttctttcttgcctcattccacagaacagcaccagccacaggctaggagcctctacccagggagggcaaggggaggttgagggctacacctgtggctgggaaaggctgaatctatgagtcccatccccaaggattctcagagcagggagtcgctgctttctggggcaggggtgcagattcgcagcaatgggaatgtgctcgaaggcctgagctgctgcttgggagagagcatgagccaaatcctggtgggcaggctgcctggtcggtgggcttcaaatctaggctgcactctgaggcctccatttgcagcctccgcctgtgcgagtgctgtgtcaccaccctgggaaggcctctgttgggtttttccagaacttggaggtttagaagtgccccagtcatggctgctctagttagaatttcgcctccagctttcccagggggcctccagccctctctgagacacagctgctcagggacagtgaatgaatgagagcaaggggccccctgtggggacacgagagtttgcagcagagatggtggtgcccaggcctggcagagaaagtgctgggggcagctgcatgatggggcaaggctcctcattggcccccaaagaaccttccatcccacctggctagagaagacaatgaaggatggtggaggggggtggttgcgccagtcagcagaaggcttcttctcttaacaaaaaggaggagtgttgagctgttccgtttggttacagatctttactactgccttctctatgaaaagatatagtgtgggggctttggtgtcacatagatctgattcaaaaacctctgttttatccttataaattctgtgatgctgtgaaagccacttaacatctcagaacctcagttttctcatccataaaatgggtggccatgctcactgcataggcttgctgtctgggaaggggcaagtagatgaagaaagtagctcagcaagagacagagatagctttgcaatctctggaatgtgaatgaaaaattgagccatcttcaccatgaaggaactcatttgcttctagagacatggcggtgggggcagacagaaggccactgctcacccgttccagtgttaaaggcagacattactgattatatctgcataccccaagcctggatacagaagcctggtagcttctcttaattgatcagaggtggcacttgaaatggaacttatgtgtcatctctgcgctctgtcaagaggccttgacagccaccctggaggagtccctaggtggtgagggaagatttaagggaaagtaagtttgctttttaggtcttctagtttgagtgcctgggaatagagatggtttctgattgagcagcccaaaggctctatcatgttccagtagcttaagctactgagaagaggccaggcttggagtgggccttccggatgaccactcacttggcagggctggcctcactgaaggtggactcttacctgcctcccactgggagcagatcctgagacaaggattggagtacaagtagcttatttgtgaagtgaacctaggatctccagtagaagagtgaggaagtgagactgggaagagaaggcagtgagggagctggggtatttatacgccaattcccattgatc

SEQ ID NO: 13 - DNA, 3591 bp, Artificial Sequence
  Based on Homo sapiens sequence
acactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctggggaggttgaaattactcatgcaagacactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcaatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcggccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttcttccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 14 - DNA, 65368 bp, Artificial Sequence
  Based on Homo sapiens sequence
gaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagaggtaagggggagcgcggaggcgggggtgggggaggggtcggcacgaggcttggtttcttctcttctctaaggcctggaaaagctgtgggcccagccgtagctggtggaggccagacctacggcttgagctttccgtcttgcattgtcgcccactttccctttcccttccacgttccgccgcggagtgaatcgtctctgccccccctgggctccacgttagatacaaaacgatcgatctgccccaggggagcccttccctgagcccccttacttaccggagccccacagtaggttttcgggcctgggacactctcgccccagccgttgccttgaagttagcctctacccaccctttttagcgaggtgctggccaccaacggatatctttcccttcctctttggccatctagagcccgccaccaagtgaactgggccccacccccttggaattgagctaatacctacctttttagcagtctcctggcttgcttaagatagtcatgaattttgccatcctgcctcttttgcgcattggagggtgcagtaaactgtatatcgccattcattctaggcgattactaagctccacattaaaatgttactttctcatttttctttggtcgtcaatcctgcttttaaatacggttttccggaatagacgtaggactatgaagatttttcggaggttatgtaatatggatttgtattgccatggaaatgccattttgatactgggcagagtggagccaagagaagggaagagattggacctctgttgcaccctactgctgtattagtgtgaagtactctgtgtattaggccgtgggcagtaatgtataaataatttttgtatagtctttggagcttttaatttttttaaaggctatttccaaaaacattcagaggacttgaaagggattaagttggtcataagttactcatgattcaagtgaatcttatagtattctaattcatttaacttaaagccttggtttttctttttcttttttcttttaagctttggtttttgttcctctgtaaaatgaatttatagtagtatctatacgttattggggttggggattgagaaaaacgtatgtaaaatccttcgtgcagtatccaggtaacacacataagcatttaaatctatattgacataatttgttatttaaggattttcaatgaaatgtaagagtccaaccctgactctgtaatttttttttttgttttgtgttgttgttttttttaagacggagtcttgctgtgttgcccaggctggagtgcggtggcgcgatcttggccactgcaacctccgcctcccaggttcaagcgattcgcctgcctcagcctcctgagtagctgggactacaggcgcgcgccaccacgcccggctaatttttgtagttttaatagaggcgaggtttcactatgttggccagaatggtctcgatttcctgacctcgtgatccgcccgcctaggccccaaagcgctgggattacaggcgtgagccaccgtgcccggccttctgaatgtatttttaaagtaaaactagtccatgttaacattgggtaactacttcagacctaacaggaatttggaattttcaagttatgtttttgtccacagacaaattagcagtttacttttcttatttacacatgatttagtgaaaatttacattattttatagctttggaagcaaaggaatcatttatcaatcttaacatcttgctaaaacagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgctgcagcccagaactccagggctcaagtgatcctcctgcgtagctgtgactataggcaggcacaggagtgttgctctttaatcattgaaaatggtaaaacaacaaaagtggcaatgtcagaaaaagatcaactcttttttggagatttccaaacaattgagtattttcatacttctgaaaagctttgctgtaaaagtagtttttctgttaagcatttcccattcttctttgggcataaaacacttttttttttctaggaataattcctgcagacctgacacataattggaagtagatattgaatgaatgagtgagttgtatgtgaatatttgctcagaggaatctcagttcattatcatttcagaaatttggcacgtagtgtactgatggagctagtctaaaataatctatcctgggagaaataattttgtttctatctggataagtctacaatagaggaatgcttattagcagtgttttgctgtattttgcatacttgcagtattcttaagagtgcagaaaaaaatagtttgaaagattcaaagagaaaaaagtgaaaaaagaaaagctgagtgcatgcatatgttgagtactagagatatgtcttcagggtttctttttggaccagatttcttgagataaaatttgcatacaataaaatgcatctgttttaatttcaatgagtttagacaaatgcatatacttgtgtgaccaccgctacactagaggtagggaacccttctatcataggtttctgttattttatttaatttttggggggcctcactctgtcgcccaggcttgagtgcagtggtgtgagctcggctcattgcaacctccacctcccgggctcaagcgattctcccatctcagcctcctgagtatctgggaccacaggtgcatgctaccacacctggctaattttttgtatttttggtagagatggggtttcaccatgtcgcccaggctggtcttgaactcctgagctcaagtgatctgcatgccttggcctcccaaaacgccgggattacaggtatgagccactgcacctggcccaggttcctgtttttattatcgtgggctatagagtttcttttttttgagatggagtctggctctgtcgcccaggctggagtgcagtggcacaatctctgctcactgcaagctccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgttatggaaaaatttgaagtgaatggaatgggtatattggcataaacgaaaattaaatatatctggttaactctgcagaatgaattacacatttaaaaaccataaaatataacttaaataccaagaatatagagttttactttttttttttttttagacggagtcttactctgtcgttcaggttggagtgcagtggcgcgacctcggctcactgcaacatctgcctcccaggttcaagcaattctcctgcctcaccttccagagtagctgggattacaggtgcgcaccaccacacctggctaattttgtttgtttgtttgtttgttttcttttgagacagagtctcactgtgtcacccaggctagagtgcagtggcgcgatctcggctcactgcaacctcggcctcccgagttcaagtgatctcctgcctttgcctcttgagtagctgggattacaggcacccgccaccacacccagctagtttttgtattttagtagagacggggtttcaccatgttggccgggctggtctccaactcctgacctcaagtgatcggtctgcctcggcctcccaaagtgctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcctctgcactcctgggtgacagagcaagactccatctcaaaaaaaaaaaaaaaaaaatgcatcctagggattcctttacctataaagttttctaaatattttaagtatactgtgttttctgaaattgaagtttagttttattgaatatggtattatcccaatttaagtcaaaggaattctgaggaagtagagctgtgagcatgtaggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaagtggagccaactgttaatgttggttaaataaatatgtccgtattataataatttactgcattattattattttattatttttgaggcagtcttgctctgtcaccaggctggagtgcagtggcttgatctcgggtcactgcagcctccacctcccgggttcaagcaattctcctgccttagcctcccaagagctgggactacaggcatgtgccaccacgcctggataatttttgtatttttttcatgttttattgcctgtatttttttttttttttttgaaacagagtctcgctctgttgcccaggctggagtgcagtggcgcgatcttggctcactgcaagctccgcctcccaggttcacgccattctcctgcctcagcctccctagtagctgggactacaggcgcctgccaccgcacccagctaattttttttttttttgtatttttagtagagacggggtttcaccgtggtctcgatgtcctgacctcgtgatccacccgcttcggcctcccaaagtgctgggattacaggtgtgagccaccgcgcccggcctgtattttgtttttatatgtatcattaattcttaaaaattaagattttgaatctctttggatatttattaggcttcaaagatcttgatggagcagtctgagttgactgccagtttcttaagttggcggtaaggctggggtgcagcgcacactggtttagcgtgagcagtgatcactaagcacatgagctacgaccaccccaactttacctcgttcacagacagaactggaaggttggtcctagatggctgcttggtcctggatgctttagtggtctcttgatatgtggaaagccttgttttggaacaaatgtttccattgatacagatgagaaatgcctctttaatatttttataaaccatttagaccccaatagatttggtttgtgggtcactctcttgtgagtaccaaaggatttcatggttggaaggtgtgccttttcgtcttggcagtgagcagcatttaatggagagacaatgcttgtatttgattttttttttttttttttggttcatttacaggatctgagacttattcagactaccagctgtattatcaggaaggaacaaatccaagttttgacgtattgtcagtgtgccgcatgttgtattttcaaattcctttagtggttttaacattagatgaccaattctttggcactgatgtgcttttgccagtgtacggtagatctgaccatggctctgagaagtctggctggcattaccacatcccaagctctctgtccaaagagaaggaagcgccagggacgcacgcttccttggctggactgcaggaaaagagctgcagcaccagcctctcattactgcagccaccccctctcctaatttttgtatttttagtagagatggggtttcaccatgctggccaggatggtctcaatctcttgaccttgtgatccacccacctcggcctcccaaagtgctgggattatgagcgtgagccaccacgcccagccaatttactgcattataaaggtggaataagactttatttttattttttatttttttagacagactctgtcacccaggctggagtgtagtggcacgatctcagctcagtgcaaactccgcaccctgggttcaagtgattctcttgcctcagcctcccgagtagctgggattacagacatgtgctaccacacttggctgatttatgtatttttagtagagatggggtttcaccatgttggccaggctggtctagaactcttgacctcacgtgagccccctgctttggcctcccaaagtgttgggattgcagacgtgagccaccatcccggcttggaataaaacttttgtgaactgacatgaagagatggcaattataacgagggagaaattcacatgatgtgattggttgtagaaaaataaaaattattagttcatagaatgatattaagaagagcacagcagtagataccaaactgttgggattgggggcaaggaagtggaagacttaaactttttatgttttctctttttatgtttctgtaaaacatgaaagacaaaatagtagagacaaatatttttgtttgttttttgagatggaattttgctcttgttgtccaggctggagtgcaatggcacactacaatctccacctccctggttcaagcgattctcctgcctaagcctcccatgtagctgggattacaggcatgcaccaccatgcccagctaattttgtatttttagtggagatggggtttctccatgttagctagactggtcctgaactcccaacctcaggtcatgtgtccgcctcggcctcccaaaagtgttgggattacaggcatgagccaccgtgcctggccgaccctgtttcttaaaaaaaaaaaaaaaaaaaaaaaaaaaaaaaaagtgtgttgctgaaaataaagtttgaggtgaaaaaaaaatttttttctttcttttttttttttttttgagacagggtctttctctgtctctcagcctcaagccatcctcctgcatcagcctcccaagtagttgggaccataggtatgcactatcatgcttggctaatttggaaattgtttttaatactaaaaatgctaatgtttaaatattaacattaaatggcaatacttaataaaatgacaaagttttctttaacatgacaaactaagtgaaacagttaaatgtgttcttttttttctttttctttttcttcccaccccgagacagagtcttcccctgtcacccacgctggagtgcagtggattacaagtgattctcctgcctcagcctcccgagtagctgggattacaggcgcacaccaccataccctgctaatttttttttgtttgtttgttttagtggggacggggtttcgccatgttggtgaggctggtctcgaactcctgacctcaggttttccacccgctttgacctcccaaagtgttgggattacaggcgtgagccactgcaaccaacctgttcttaaactttaaaaaatcaaatgctagcttctgattcttcagttttgattcaagaatggttacaaagtttacttttaagtttaaaaaaaaaaactatgacttttttttctcttgtcaaaagttgtatgttctctttatatttgaatggttactatctgactggaagtcaggagtttatttccccctgctgagatgtatggttcatgagcacatttgtctcttaggtagtggccagcattgaagcaacaaatactgtgtaacttggtacctttagtttttaggattctgatagatataagaaaaatgggccgggcgcggtggctcaggcctgtaatcctagcgctttgggaagctgagtcaggcagatcgtgagatcaggagaccgagaccatcttggccaacatggtgaaaccccgtctctactaaaaagataaaaattagctgggcgtggtggcgcgcacatgtaatcccagctactcaggaagctgaggcaggagaattgcttgaacccaggaggtggagattgcagtaagccaagattgcaccactgcactccagcctggcgatagagcgagactccatctcaaaaaaaaaaaaaaggccaggcatggtggctcacgcctgtaatcccagcactttgggaggccgaggagggtggatcacttgaggtcaagagatggagaccatcctggccaacatggtgaaaccccgtctctactgaaaatacaaaaattagctgggcgtggtggtacgctcctgtagtcccagctacttgggaggctcaggcaggagaatcgcttgaacccgggaggcggaggttgcaatgagcagagattgcgccactgcactctagcctgtccacagagtgagactctgtctcaaaaaaaaaaaaaaaaaaaaatcagaacacttaaaaactattagatacccatctgaattctcagtttggtctaaaaagattcgtttatgtgtggtatttaatttttggatattaactgaacctcaaaatttttttcttcctttatatgtattcctacatgattgtaggagtctgtcctgaacttcgatcatgtacattttggaaacttattttagaaaaaatctaagtcgtaagaattctcaatgaaaagagggtctttgccaatttctttgggtaagaaaagttcagaattttgcagatactctaaaaatgaaagtcaacaaagaaggcatataaaattgtgacgttttcaaataaaatgatttgtcatgtccttttttctttagactgctgcagtaagaatgtcttttccacctcatttgaatcgccctcccatgggaatcccagcactcccaccagggatcccacccccgcagtttccaggatttcctccacctgtacctccaggtaagtttgttgatactgttttttgtcgttaaacttgtacttttgtctttgtgatactaacttcaggaaaatgttagatatgtgactgtgttagtgaagatgcctctcagcgttgtttgggaaatgtggatgtctctttttcctatagcagtagcttttatatctggctgagtatcaaactcatctggaaatttttttttttcttctcatctggaaagtttttaaaaaattctttttttttttgagctagagtcttgctctgtcacactggctggagtgcagtggcacgatctccgctcactgcaacctccacctcctaggctcaagcagttctctgcctcagcctcctgagtagctgggattgcacgcacctgccaccatgcctggctaagttttatatttttagtagagacagggttttgctatgttggccaggctggtctcgaactcttggcctcaaatgatctgccggcctccggctcccaaagtgcgggattacaggtgtgagccaccatgcccagcctaaaaattctatatttaaaaaaaatgggtaatacatacacattgttcaaaaacaaaaaaaaaatacagaaagtaatacagtgaaaaattttcttcatatactcccataactgctattgctatccccttactaaaaagggaagcaataaggttattagttttttcttgatttttccagatacttaaaagtgtatattataagtcaatataagtaaagatttatggagttaaaaaaaatgttcagaccctgctccatccccctgaatcagatcctcagaaattggggctcaggattcttaatttttaacaagttcacaggtaatttttggcactcatttaagcatggagaatccacatttgagaaccattatcctgaagtacatagtgaacattgcttatgctgggtgtggtggtgcgtgtctgttgtcttggctattcaggagactgaggtgggaggatggcctgagcccaggagttcaagtccaaagagtgagacctcatctttgaaaaaacaaaaatctttgcttataagaaatttttcttttgacttaagaacattgcagttggctgacttatgatgggttgttaattcatagcatgtatgttacgggggttgtataaacagcacatttgtctttattttgtttgtgtgtgcgtgtgtgtgtatgtgtgttttgggcgaggcctcactttgttgcccagactggagtacagtggcacgatcatggctcactgcagccttgacctcctggactcccatctcagccctcctgaggagctgggaccacaggcttttgccaccatgttcagttaattaaaatttttttaaaaaacattttataaagatgggggtctcaccatcttgtccaggctggtcttgaacttctggggtcaaggtatactcctgcctcagccttccaaagttctgggattacagatgtgagcccctgcacctgaccttgtctttattttggattcaactactcattgtaaaatttttaatttactgccacaggctcagctttgggaaccttctacccttgggtctgaaaagccccaagataaatatgggaatttctgtggaatattatttaacacttcaagaatttggggaaaatcataatttaaaaaaatcaggccgggcacagtggctcacgcctgtaacctcagaactttgggaggccaaggtgagtggatcacctgagttcaggagttagagaccagtctggccaacgtggcaaaatgccatctctgctaaaaatacaaaaaattagctgggcgtggtggctcaggcgtgaatcccagctactcaggaggctgaggcaggagaatcgcttgaaactgggaagcagaggttgcagtgagctgagatcatgccactgcactccagcctgggcaacaagaatgcaactttgtctcaaaaagaaaaaaaaatcagaacaactgtttatgcatgtatattatggaatagaatgcagtactttaataagctattttagacattatgcttgtagtggagctgctttacgctgtgcttctagataatcatggatgtatatttgttatcatctgctgccagaagagtaatgtaaaagtttacactactgctttattatcccatgtaacaattactgattttaagtagtaacttagttgttttataatggaccataaatagactaaattctactggaaggctctagctggccctttggacaaagttttttcttaaaatgaattttgctgaaaggaaattctattgagaaaattgagaaaatgttgcagaaaactgaataaagttagttatcagccatcaaacagattaatagttatagaaggaaagtgttttgaacaactttcatttgggcttcagttttctctttggtccgtatatcctgattttcttcatatatttataggctcataatgcagttctgggttttaatttttaatttattaatttttttgagacaggatctctctttgtctcccaggctgggggtacagtggcataaccataacttaatgtggcctctatctcctggactcaactgatcctcctgcctcagcctactgagtagctgagactatagatgtgtgccaccatgactgactcagatccgtttttcgatgggccttaccataaccatgatgcaaagcccgagtgttctagaagttataggctgggcatggtggctcatacctgtaatcccatcactttgggaggctgagggcaggaggatttcttgaacccaggagttcaagatcagcctggacaacatagggaagaaagaccctgtcttgtggggaggtggggggtggcagtaagcttaattgcttgtttagaatcagaaaagatggttatggagaatctgtgctttaatttccttaccagtagattgggtttatagaaaagattttaaatttctttgatttttttttttgtttgttttgctttttttgagagagtctcactctgtcgctggagtgcagtggtgccattacagctcactgcagtctctgcctcctgggttcaagtgattctcctgattcagtctccctaataactgggattatgagtgtgtgccaccatgctcggctaatttttgtattttctgtagagatggggttttgccgtgttggctcaagcgatgtgcctgtcttggcctcccaaagtgtttggattatgggtgtgagctaccgtgtcccctcactccctgcctttttttttttttttaaataaagaaatggagttttgctatgtttcctaggctagagtacagtggttatacacaggcacaatgctagcacaccgcagccttgaactcctgggctcagggatccttgtgcctcagcttccagaatagctgtaactacaagcatgattttatttatttatttatttttttggtacagagtcttgcacctgtcccccaggctggagtgcaatggtgtgatctcggctcactgcaacctctgcctcccgggttcaagcaattctgcctcagcctcccgagtagctgggattacaggcacgcaccactacgcctggctaatttttgtatttttagtagaaacagggcttctccatgttggtcaggttagtctcaaactcctgacctcaggtgatttacccatctttgcctcccaaagtgctggcattacaggcgtgagccactgcgcccggcccatgatttttattttctgcgaaagagccaggaataacaagattcttcttagatttacacataaatttctcatctcatgcttaaaataactgtcaaaagatttgtttttactttatttgacaaaattttatatgtttatcatgcacaacgttttgaaataacatatgttgtggaatgactaaattgagctaattaacacttggtgtattactttacatacttattttttgttgttgtgagaacaccctagattttaagtggagattttctcttagttattttcaagaatatagtacacttactaactgtatcaccatgttgcacgacgtgttttaccttttttttggtcttttttttttttcctttttgtggagaacggggtctcactattttgcccaggcagatctcgatctcctgggctcaatctgtcctcctgcctgtgcctccctaagagctggaattacaggcgtgagccaccgtgcccagctgtttttacttttaaaggattctttaatagcattgttcacctataagtcagtctgtatttgtgaaaggcattggttttgaggatcaccgaaccacatgaacccgaatggataactatccaggattttatgctctttaagtcaaaagcatattgaggtggccattttgttttcaggatagtcttttttgtaagtttatatggaccaacctgataccacattccttttgaaaataagatagtatttatcagtatttcactttcatttgtcttatatttccacttatgttaattatgagtaaggatacttaattgtgtggcatgttgttgatagagaatgcagtcatgtaaaatcagtgtggtttttcttttcttagggaccccaatgattcctgtaccaatgagcattatggctcctgctccaactgtaagtataacttaaaggaggaatcatgagttatggtagtgctagtgcttttaagctgaacagcatgataaacttagataaattatgagtatttaaaagaataacaaggacagaatgacagcacccctgtagagcatatcatttatttgaataagtatcattttcacttaggtgtgcatatatgcagttgcccttgcaatgtgctccctaagtagataattctatgattttcctgttactatctagactcttcatatacttgttattacaaatttaggactttggctcttcattgccttctcatcttggtcctgggagatgggagaaggatgtgacatgtctgatctcttaaaagaacataggaatccttgtaaaaattaaaattttgaaatgaaatttgtgtggactaccttttacatgtttcctcctaccttcctaaggtatatggcctaaggcataaattttaaatgttcaagacataggccaggatcacctgaggccaggagttcaagactagcctggccaacatggtgaaaccctgtgtctactaaaaatacaaaaaattatctaggcttggtggtgcgcgcctgtaatctcagctactcgggaggccgaggcaggagagtcccttgaacccaggaggcggaggttgcagtgagccgagattatgccactgcactccagcctgggcgacagagcgaaattccgtttcagaaaataaaagtaaaaattatgtcttaaacataacaaagttttcttggttatttttgtttcttttttaagaagaaaggtaatctagtagtagaagtttacttgtcacaaataagtttgcattaatgaaatgtgctatgcactttaggagctttagaagtatacaagcatgcagagcttaaataatgtgctatatatatttatttaatcctgatgtttttagcctaatgttaattgtggtaggaaatttaattgctggatcaatttttattttgtttcttcaccttaggtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctgtaagttaaactgtttatttttcattaaaaatttttttatcattctacatttcaaacttaagcagaaagaagactttcagtgattgctttttattttaaaaaatttcagtcctgcagcaaaggtgaaaaagtacagtgaacacgtttgtattcttttcctagattcaccaatgaacatgtttagatattttatgtacacatgtgtaccacacacacttttttcttggataatttgaaagtaaattgtggcataacatttcacctgtgaatccttcatttatctcctaagagcaaggacattctgcgacataatcacaatgccactatcacacatgaaatttggccgggtgcagtggcttttgcctgtggttgtcatcctagtcctttgcaaggctgaggcaggaggatctcttaagctaggagttcgagaccagcctgggcaacatatcgagacacatctttacaaaaaattaaaaaataatagggccagatgcagtggctcatgcctgtaatcccagcacttcaggaggccgaggtgggcagatcatttgtggtcaggagttcgagaccagcctgaccaacatggtgagaccctgtctctacaaaaaatacaaaaattagccaggcgtggtggcgtgtgcctgtaatctcagctactcgggtggctgaagcaggagaatcccttgaacccgtgagatggaggctgcagtgagctgaggtcgcgctactgcactccaccctgggcgacagagcgagactccatctcaaaaaaataatgacagggattaaaaaataaaaataaaaaaaaagccaggtgtggtgatgcacgcctgtagtcctagctgttcagaatccgaggtgggagaattgcttgagtctaggagttgaaggctgcagtgagctatgatcttgtaattgcactccagcccgagcaagagagtctctaaaacaaaaaaatatataaaattgatataatattgttaactaatgcacatgtagttcatatttaattttcccagtaatggccataatattaatagttgttttatttttcatccatgatccaatgaaagatttttatttacttttgagacagatttgctctgtcacacaggctgaatgaagtggtgacatcttggctcactgcaaactctgcctcctgtatttaagtgattctcatgcctcagcctccctagtagctgggattacaggcgcgtgccatgacacctggctcatttttgtgtttttttagagacaaggtttcatcatgttatccagacttgtcttgaactcctggcctcaagcaaaccgcctgcgttggctttccaaagtgttgagattacacgcgtgggccaccacacctggctagggttaatattttgagactgtgagtccttttccccaatgatgttaaacaatgattttagcatccaatgatgattgactgattccttttaaagttttattctgagcttgaatagtaataagttgtttaaatttggtaagcttgttgattcactttttttacctttttaagattttatcttgatgatacatgtacattgttaagtgaaataatgctgaatgattgtataataaaataaggccaggtgcggtgtctcacacctgtaatcccggcactttgcggggccaaggtgagtggatcacttgaggtcaggagtttgagaccagcctgatcaacatggtgaaaccccatctctactaaaaatacaaaaattaaccaggcgtggttgtcggtgcctgcaatcccaactacgcgggaggctgaggcaggagaatcatttgaacctgggaggcggaggttgcagtgagttgagatggcgccactgcactccagcctgggtgacaatgttagactttgtctcacacacaaaaaaaggagtttggaagaatgactatattctgcactgagaggatctgcaaagatgtcattcttcgtctgtatcccagaatcttgtgtaggttctctgtaaggacagggccagggttatctcaacctgtggttcacctcatgagtagttcagtatgagtcctgcaatcttgccatcctctggaaatattgttgcctgctctccttatgcccctctgagatgctgggcaattactttacatcattcatgattcttgttcctcaactattcatatttaagaaattcctgttcttttagaagactggatctcctgggcactctgtaagttttaattaactggtttgaggatgttttgggtttctcagttttgttttcttctattacttccatgggatttttggtaatttcagtctgaagcctgactccatttttattcttgagttttctcctgggcttcttttcactgtagccacaaggcctaatctgaggtctgcagagaactagcacttactctgctctaatggaattcaggaaagtcagaaggtactggagtatagaaatgtgtttgctcctgtctgcttctggaagtctctgttttgctatgttattactgctaatgttttctccctaggtgtatgtgaaaagattctcatcacaaattctcatagaagtgccgtttctgagtcttagggcatgcttatctgcagctttacaagataattccacaccaatttatttatatttactgcagcagtgtcatgtccgagtttctattcttacacatcttttttttttttttttttttttttttttgagatggagtcttgctctgtcgcccaggctgtagtgcagtggcaccatcttggctcactgcaagctccgcctcctgggttcatgacattctcctgcctcagcttcccaagtagctgggactacaggcgcccgccaccatgcccggctaattttttgtatttttagtagagacaaggtttcaccatgttagccaggatggtctcgatctcctgacctcgtgatctgcccgctttggcctcccaaagtgctgggattacaggcgtgagccaccgcgcccggccctcttacacatcttttttaacaattggtgtttatttagaattttacattgtgttgtgaaataccttattcctatttcaatatgcctttttactgttcttcataattttgatattatctgttgacatgttatggtagcttgaggcctaaactgttaaaggcctcagtctcccttccctacttccttacaggtgttacaagatggcgaacttgataataagtattattatgtaaatagttttagcagaactaggttatgtgctatgattgtattttctttctttggtttgttttctttctttctttttttttttttttatttgagatggagtctcactctgttatccaggctggagtgcagtggcgtgatctcagctcactgcaacctcgccatccggggttcaagcaattctcctgccttagcctcccgagtagctgggattatggatgcctgctaccacacctggctaatttttgtattttcagtagagacggggtttcaccaggtttgccaggctggtctggtactcctgacctccagtgatctccctgcctcagcctcccaaagtgctgggattacatgcgtgagccactgcctagtccattttcttattttaattttttattttttatctttgagacagagtctcgctctgttgcccaggctggagtgcagtggcacgatctcagctcactgcaacctccgcctcccgggtcagtgattcttctgcctcagcctcccaagtagctgggatttcaggcacccgccaccacgtccggctaatttttgtatttttagtagagatggggttttaccatgttggccagactggtctcgaacttttgacctcaagtgatccacccaccttggcttcccaaagtgtggggattcttttcccttcttttctagagctcctcctgtcaggtccctttgttcgtctcatgtgttctggttcctctaagtctacttttatccttggatttttttctgtcttttctagtattccccttattgctgttctgtgttgggtggtttggatcctatatcttgcttgtgccgacacatagtagttcctgttatattgggatgatacatcctctgtatatgatgtacatggtatatatgggtatgtggttggtaacttttctgaatctaaatctgaagtgctttttatttcatgtggtcagtagtttaccgggatatagaattcggtgatgaagcttatcttcctcacattgaaggtgctgccttatcgtgttatagcatctaatgatggttttcagaagtcccgcatcattctgaatgctctttgtgtgtgaactgtttttccctggaatgcctctcctagtgaggatttgactgattggaggttttagttcctaattatgtgaaattcttcgaatgtttatttgattttcttatttttcttatatcattgtgttggtcacttacttggtgggccatttcgttctggagccttttttcaggagaaaattttgagctatttgagaattctttttactttcttcaggaactctgtttggatgttgagcttccaggtttgacctatgtgtttttgatttcctattttccatctcttactattttgcacgggttcttgggatttgtccttaactttaccttccagacttacattgaaatatttatttttaatgccatgtttcaagtttccattagttttctcttgttctctgaagatttctcacctacaccctcctccttctgtcttttttttaactggatggaactttattttatttttcttttttgagacagtctcattctgttgctcagactggagcatagtggcatgattacagctcactgcagcctcgatttcctgggctctagccatccatccgtctcatcctcctgagtagctgggaccactggtgtgtgccaccacgcccgcctaatttttttgtttttgtagagacagtgtctccctatgttgcccaggctggtcttgaactcctgggctcaagcaatccttccacatcagcctcccaaagtgttgggattatagacgtgagctacacctcgctgcttttatttttaaagtataatagtgtcctaccgttcagataacctgccctccttcacattttggaatatttctctttatttttacagaaagctgtttttgtttatagttagagtcttgctgtgtatctgcattttcttttcccaagttatttttgcataccgtatcaagcgttttcccatgttaatgggatggctgggcgcagtggctcgtgcctgtaatcccagcactttgggaggctgaggcgggcagatcacgaggtcaggagttcaagaccagcctggctaatatggtgaaaccccgtctctactaaaaataaataaaaaaaaaaaaacaaaaaacaattatccaggcgtggtggtgcctgcatgtagtcccagctacttaggaggctgaggcagaagaatcgcttgaatctgggaggcagaggttgcagtgacccaagatcacgccactgcactccagcctgggtgacagagcgagactccgtctcaaaagaaaaaaaaatcctttataaatacatacatattgtttcaaaacatttctttatagattcataatatttacttaaatttattatagtttgttttaaccattctaattttaggcatttaggtttacgtgtttattttgttaggataagtagtgatgcgaaacttttaataaaaggtaaacaatgttctgcaaatgaagaatcagtaagaatttatatttttctttaaatgatttgttgttcatttctttcatgtgataagtttgtgggaattgcaaaaattttcgcaaatgtagttgctggttttttattttatgttttttatccctagtagaaatataattttgcttttagttacattaaaaattattttgttaaatggtagcaatctgtttgttttgttttctttttaagaaatgtggtttggttttgagctggaagagagtacaaggtgcttccggaaagcttcaaggtatgtcatttttttccttatttgctgaaatcactttaactaacctgtgtgcttaaatcactttgcatgacttaactctcattgtctttatcagtaagacttattttattagcactctttgtcctcttttttattgaaatagggttaaaaggcagtttgggaaaatattggctgagaattgagatcagaaggaggaaaaaggtgtaagaggaaaggaaaaaattaaaattgctcaatttaactggtttcttgttctttcaaaagtctcttttgtctcaagaaatgactgcatgatcaaaatggaacaattagtaagggagaagaagagacaatcatggcctgttaactttttttttttttttttgagacctagtctcactctgtcacccaggctggagtgcagtggcgtgatcttggctcactgcaacctctgcctcctgggttggagcagttctcctgcttcagcctcctgagtagctgggattacaggtgtgcgccaccatgcccggctaatttttgtatttttagtagagacggggtttcaccatgttggccaggctggtctcaaactcctgacctcagatgatccacccgccttgacctcctaaaatgctggcattacaggcaggagccaccacacctgacctcaaatgttaattttttaaatagttgatttgattcaggatctatatgaagtccacacattgcaactagttggcaatttgttttaagtctcctaattttttttattagcaccatcctctaaccaactgagctaactggccagactcttaatattttaagttattctatttctaattttccttgcagtttatttgttgaagaaactgggtcatttgtgcaatagtattttttaagttgagttttgctgaatgcagctccagtactataatttgccattaatctatcctctgtgttttctgtaaagtggtcagtagttgtacttgatgtgtgctgtgtggtggtttgttttgttttgtttgtgttttttatttttttggaggagtttcgctcttcttgcccaggctggagtgcagtggtgcgatcttggctcactgcaacttccacctcccaggttcaagcaattctcctgccccagcctcccgagaagctgggattacaggcacgtgccaccatgcccggctaattttttatttttagtagagacggggtttctccatgttggtcaggctgctcctgagctgctaaccttatgatccgcccacctcagcctcccaaagtactgagattataggcacgagccactgctcctggccgctatttttttttttaatgtttttattctagcaccttatagcaagaatactataaaggtagtattcttccatcagggaacacatgtgagattgtcttttttgtatgtgtaatagcatcagtgttgccagtgcctagattgattaattcattaggaagtaattcatcagtagtcttttttcttttttttgagacagagtcttgttatgttgccaggctggagtgcagtggcataatcttggctcactgcaatctccaactccctgattcaaacgattctccagcctcagcctcccgagtagctaggattacaagcatgtaccaccccacccagctaatttttgtacttttagtagagacagggtttcaccgtgttggccaggagggtctcgatctcctgatctcgtgatctgcccgccttggcctcccaaagtgctgggattacagacgtgagccaccgcgcccggcctcatcagtagtctgttttgaagaattctgtcattcttttattgaggaacaaatctttttcatatattagtagaatgcttctctatggagaaagttgcccctgcatctactgtttggtaacttagaggcatttttgttgttcttgagatggagtttttcgctcttgttgcccagactggagtgcgatggcaccatctcagctcgctgcaacctccgcctcctgggttcaagtggttctcttgcctcagcctcctgagtagccaggattacaggcgcccaccaccatgcctggctaattttttggtttttttaatagaggcgggattttgccctggttgccaggcaagtcttgaacacgtgacttcaggtgatccgcccacctcagtctcccaaagtgctgggattacaggcttgagccaccatgcctggcatagaggcatatttaatacagaataggcaggatagatgcactggcttgctttcttaaaacaatgagttgctatcctcagcattctctagcagtgactgattttcttttttcttttgaattattgtgaacttaggaattgaagcatatttagtgttattgtatttaatatggattcattgtagttattatcaccattaaagcttaacttaaattgtctctgcactttacatctccagtggttttgacatgaccctgaacacctttgacagctgctttgttatctggtatgacaatttgttctaaggtcatctagtataataggttttcggccccagacttagaatcagccatttctccaggggaaattgttttgaagatcacgatctggacactaggtgcactcatattaacagtggtttgggatgggtgtggtggctcgagcttgtaatcccagcactttgggaggctgaggcaggcgggtcaagagatcaagaccatcctggccaacatggtgaaaccctgtctctactaaaaatacagaaattagctgagtgtggtggtgcgctcctttagtctgagctactcaggaggctgaggcaggagaatcgcttcaacccgggaggcagagtttgcagtgagccgagattgcaccactacactccagcctggtgacagcgcgagactccgtctaaaaaaaaaaaaaaacaaaacagtggtttggtgtttgcttttaggtttttccagtgtatactaattcagattcaggactaaaaggtttttatttagcctgttttgtcatatatttgtatctcctttttccccacactgaggtccccgagtttcaaggccattggggatgataaactattaattactgagttgctttatcttgcattgcacatataacagtttcacactaacaacattgacactatcatcagcaatatgatcatttaaaattacttttctttttttttgagacagggtctctgtctgttgcccaggctggagtgcagtggggcaatctcagcttactgcaacttctgcctcccgggttcaagcaattctccttccttagcctccctagtagctgggactacaggcatgtgccaccacacccagctagtttttgtatttttagtagagagagggtttcaccatgttggccaggctggtctggaactcctgatctcaggtgatctgcccgcctctgcctcccagagtgctgggattacaggcatgagccactgcgcccggcctaaaggtacttttttgaggggcatatctgtttgtctttatggtatatcacactgaaatgtcaaatttactattttaatatcagtagtttttttctgtttcctgtcattatatacatatttagatttatttgattttattttcaatttgttggttgctcttcttagatttaattttgttttaatatttctgttaaagtcatcttaatagtgagattgactagttataaaaggaaatagatgtaagtaaaatagactggtaactaggatacaaattctgtaatttaacatctcagaattgaaaagtgcattgtttgtgttcctgcagtctgttctttcttgtggctgtttggaagtctagatagggtgaatttatgaaataattgactcctttctttttttttttttttttgagacggagtctcgctctttcgcccaggccggactgcagtggcgctatctcggctcactgcaacctccgcctcctgggttcacgccatactcctgcctcagcctcccaagtagctgggactacaggcgcccgccaccgcgcccggctaattttttgtatttttagtagagacggggtttcactgtgttggccagaatggtctcgatctcctgacctcgtgatccacccgcctcggcctcccaaagtgctgggattacaggcatgagccaccgcgcccggccaattgactccttttaatcatgaatttcattgactctgctaaatattttattagagcttctaatgagtagcagtttgtctgatttgaatttttcttcctctctgtttttccctttttttcccctttggttgtttgaggatactaaaagtgaaatggttatcaaagggaattggtggacaggggtggaattatgaattgagtggtctttgtattaaaacatttggactctagtgattctacttttccataattttttttcttttgtaagtgaattggtatttcactaattgttttcatccattgctagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggtatgttttctgtcgtgttatcttttctaggccagactgtgctatttcagtgtagtgcttctcattataaatgaatctaatatggggcttcaaaagatcatcatgtatgtgcttgtggcttaatgtaggagggtattttatagtttgtagttattttaagtcttatctgcccatagtgggtggatgactgttggtttgcttgttccaggttgggatgaaagtagtaagggaggctggacaaggttaacttgccagagaaagcactggtacagactattccaaacagagctaattcattaaggcagctttgtaagtaagtacaaaatatatttcaacctacacaatttttattagtttccctctcttttagaagtacaccgactctaaaatgaatgaaagtctgattacttgccttaggttgggggctttatccaagctctactaagtgaagctaaaataaaggacattgttgtatattgtattttaatgtatacattattacctcctcagcaaagtgaaacatagctaaaacttgagtatatatttccttcatttctcttcttagttcctttttggcatctcatgctgaacaaatccaaaatagatttattaatgccttcccccaacacaaacaaaaccagaagagtctttcgctgtcgtcaaatttttattatctttcaaaatagaaatcgctttttgctgggcacggtggctcacgcctgtaatcccagaactttgggaggcagaggcgggcagatcacctgaggtcaggagttcgagaccagcctggccaacgtggcgaaaccctgtctctactaaaaatacaaaaaattagcctagcgttgtggtgggtgcctgtaatcccagcaactcagaggctgaggcaggagaatcgcttgaactgcagaggcggaggttgcagtgagctgggatctagccattgtactccagcctgggcaactagagtgaaactctgtctccctgctgccaaaaaagaaaaaagaaatacctttcatgttccctccaagttctttgttaaaaaaaaataaaaaccaaacccaaaaaactcacaaaatgaagcaaagtataaataatcaattaaataccacctgtaatcccatcatcataagcaacactgtaggcggtttggatgtatgttcttccagacatttttctgtgtatgaatgtggttcatttgttttttgttttttttgagacagagtctctctgtcgttcaggctagagtgcagtggtgcgatcttggctcactgcaacctctgcctcccgtgttcaggtgattctcctgcctcagcctcctgagtagctgggattacaggcatccaccaccacgttcagcaaatttttgtatttttagtagagatggggtttcatcatgttggccaggctggtctcgaactcctgacttcaggtaatctgttctccttggcctcccaaagtgctgggattacaggtgtgagccaccacacctggccaaatgtagggttttgtttgtttgtttgtttgaaatggagtttccctctcttgcccaggctggagtgcagtggtgcgaccttagctcactgcaacctccacctcccaggttcaagtgattctccctcctcagcctcccaagtagctgggattacaggtgtccgccaccaggctcggctactttttgtattttcactatgtaagtgaggctggtcttgaactcctcaccttaggtgatctgtctgcctcagcctcccaaagtgctgggattacgtgtgagccactccacccggtcagcattgcctgtatttctaaaacataagtataattttatgaaactcttgcttatattatgtgagacccatccttaatggttttggatttcttacagaaaaaagtaccccccctctttttttttgatgcagtctcgctttgttgcccagactggagtgcagtggcgaaatcttggctcactgcaacctccacctcccaggttcaagcgattctcctgctttggcctaccgagtagctgagattttaggcacccgccaccacccccagctaatttttatgtttttagtagaggtgggatttctccatgtcttccaggctggtcttgagctcctgacctcaggtgatccacccacctcggcctctcaaagtgctgggattacaggcgtgagccaccgtgcccggccataaagtccatatttttaggatgacattcaaggctcactccagtccacgtttctagcttccgtcttccctcccctgcacatactactgcatgtacctccacagtcttcccttttgctttgctggcatctcatgtctttgttgcctatccaagctccctgttgaaattctatccatacttataattaacatgtcccttgattcatacagactttatcagcctgcccttagtttctgtcagacagaattaagtcctctgttcccatataaagcagatctttatagctgttttagtagatattgtttatatatctctctctttcacagccccttgtaacccatctcattcccatattctctttcaacccccatctctgattacagatagaaagggtgataagtttgtgggctgtgtctctttaatcttgtacctccacagcatctaggacagtgtcttgcctaaagcaaggatggaattaacatttgttaatagacgcttatctgtcagtcttactatcctcaccctgcttcataaggaaattatattttatttatattttatttcaaatcagtaatactgcctgtcacatcactaaaacctcaaaaaacagaaatgtttgaaataagaattttcaggtttgccttgtgataactgtatactaactagttgaaagtatggattcagtatcttcaaagtgttctgatttgctaggactcactgttttcttgtgtttaatcttcagtttgtgaggtcatttaatttgtagcatttgcaaatgttatactgaaaaactctgagaatgaaataagtcactatactacgtatttttataaataaggaagtgcacaattatgtgacttcacatttcttgcttgcttgctttttttggggtggggacagagtgttgctctgtcacccaggctcgagtgtggggtggtgtgatctctgctcactgcaacctcctattcccaggctccagtgatccttctgcctcagctgggactacaggtatgcaccaccatactggctaagttttatattttttgttgagatgaagtttcactgtgttgtccaggctggtcttgaactcctgggcttaagtgatccacctacttcagccttccaaagtgctgggattacaggcaggagccactgtgtccagcttacattttttgtataatcaacattagccagagtaaccacactttagatctgttggtcttcaggaaaagcaatatgtgtctggatgtggtggctcacacctgtaatcccaacactttgggaggccgaggtcggaggatcacctgaggtcaggagtttgaaaccagcctggccaacatggtggaactccatctctactaaaaaaaaaatacaaaaattagccggatgtggtggtgcacacctgtaatcccagctacttgggaggctgagacaggaaaatcacttaaaacccaggaggcggaggttacagttagctgagattgcgccactgcagtccagcctgggtgacagagtgagactctgtctcaaaaaaaaagcgaagttacatgcaataaaatcacacagaaaaattatttttaataaaaaattaaaacaattgacagatatcagttatatgatttattgttccaactgttatatgtgtatttctgagtgccctttggcttcttgcccggtggtacttgaagtcataggataaacatggcatattttccttaagtgtcaatattactcaacaaatataggttaaaaaagcattctatctgatgtaaaaaaaaattttcaaataacttaagcaaatattactatatagtggagtagattagagatttgccatgattttttttttaagggtggtggggggtgtagggagagatgaaagtcggagagtgagagattggagggagggagcagggggaggggagaagatggtgggggtgagatgggtggctactgccgccatgatttttcagtataaaaatatgacatggtgattgttttttattcttggtcgttgattagttggagaaatttagaaagctgttaagtagaggataggagaatgagacattgaaaaccctttgtgttgctttattaggcattttcctctgaggcagaagagaaaacaattagttccttatttctcattgactaaaaaggaaacatgagtttgtctaggggagcaacatatttttcatgatccagaatttttttttaaattttcttgcctttttttttttttaattaagttttagggtacatgttcaccacgtgcaggtttgttacgtatatatacatgtgccatgttggtgtgctgcacccattaactcgtcatttaacattaggtatatctcctaatcctatccctcccacctgccccccaaaattttcttttttttatgagatggggtctcgcgttgttgcccaggctggtgtcgaactcctgggctcaagcagttctcctgcttcggcctcccaaagtgctgggtttacaggcatgagccactgtgcccagccagattcagaattttaagaagaattttgcgcatgtgtaaggtgtcttgtcaaacaacttgactgaacattttaatttagattttgcagaatttgcaggtgtaactttttttctttccatttcttattgacctctagtagtaaagtattccatgtgaggtggccatgctaatttagttcatgtcctattgctttctggctgtccagcaaaaatagtataggagacaatatatctgcttgtatgtcacaagtcatagttattaaccatatattcaagaatgaacactgacaagtgctggaaaaacagttattctctggaaagaacctatttaatagaggacagctgcttcaggggaacatctttggaaattagcctggctgagtacattttctcaaaagaaagaactctgcatttccttaaattttttaaaaggttcgtactttggattctagacctcagtgccaaagaatgagcccagcagagctgtttaacttcacagctactagctttactattgaaattttaatttctctgaaaagaaccaactaggtgggccatgtaaacattacagataatctgtcagcttcctatatggctgaatccttcaccttttgtttcccagtattactgattatgctttctggtttctccctctctgcccaccgaagtctcactcttgtcgcccaggctggagtgcaatggtgtaatctcggctcactgcaacctccgcctcctgggttcaagcgattctcctgcctcaacctcttgagtagctgggagtacaggcacccgccaccacgcctggctaattttttgtatttttagtaaagatgggtttcgccatgttggctaggctggtctcaaactctggacctcaggtggtccacccgcctcggcctcccaaagtgttggggttataggtgtgagccaccgcacccggccatctggtttctgaagtataagaaaaaaacaggaaatcagaaaatcgtgtatagttgatattccagagatagagctttagatgaaacttgccagtctgtggagtggtctttctaacctgatcatctaccatgatcaggttttgttttttttttttttttttcttgagacagagtctcactctgtcgcccaggctggagtgcagtggcgcgatctcagctcactgcaagctccgcctcccgggttcacgccattctcctgcctcagcctcccgagtagctgggactacaggtgcccgccaccacgcctggctaattttttttgtatttttggtagagacggggtttcactgtgttagccaggatggtctcgatctcctgaccttgtgatctgcctgcctcggcctcccaaagtgctgggattataggtgtgagccactgcatccggcctaggttttttgttgttgttgttattgttttttttttaaatattagcaatcagttaagatttttgggttaataaacttttcttctaaaaatgtgaattagttaattccaaatgctttatctctaatagtaaaatagccatattgatatttaaattttggtttacagtggaaacaataatcaatttagggtctataaggattttttttgtcttttgagacggagtcttgctctgtcgcccaggctggagtgcagtggcgtgatattggctcactgcaatctctgcctcccgggttcaagccattctcctgcctcggcctcccaagtagctgggaccatgcccggctaattttttgtgtttttagtagagacggggtttcaccatgttagccaggatggtctccatctcctgacttagtgagccgctgcacgcggctggggaatttttgtatttttttagtagagacggggtttcaccatgttggtcaggctggtctcgaactcctgaccttgtgatccgcccgcctcagcctcccaaaatgctgggattacaggagcgaggtgtgtgtgtgtgtgtgtgtgtgtgtgtgtgtctgtgtgtgtgtgtgtgtttttgatgggggtggagacagagtctcgctctgtctcccaggctggaatggagcagcatgatctctgctcactgcagtctccacctcctgggttcaagcaattctcttgcctcagcctcctgaatagctgagattacaggcacatgtcaccatgcccagctaattttttgtatttttggtagatggggtttcaccatgctggccaggcaggtctcgaactcctgacctcgtcatctgcccaccttggcctcccaaagcgctgggttgcaggcgtgagccaccgagccctgccaagtggttagttttgtaataacatgtaatgccttatatttaagttatctgtgtcataacccatctgttactctgtagtgatacagcttgaggagaagagagcgtttttcaatttggattttattccgtctaagtgcagcatctttctcacagtatgctcttaagaatttgttgatgggtgtggtcgtcacgcctgtaatcccagcactttgggaggctgaggcgggcggatcatgaggtcaggagatcgagaccatcctggctaacacggtgaaacccccatctctactaaaaatacaaaaaaattagtcgggtgtggtggcgggagcctgtggtcccagctactcaggaggctaaggcaggagaatggtgtgaaactgggaggccagagcttgcagtgagctgagatcacgccactgcattccagcctgggcaacagagcaagactccgcctcaaaaaaaaaaaaagaatttgttgagcaaattaatttaagaaataaaatgtttgttgaatacgtatccattggagacagctttcagaatgcttgtggtcaacttataaagttactgctaagttacattgttaaggaggcacaaggcatgaaactcaccttgaatagagttgcaggaattatgaccaagagccaggcatgtatgcacatgagcatggttcttgtatgtatctgaaaatgtgcacggtatatgtttaccaagtaagtcgttaaaaactttggggcatgcacaactattgtagcacaactattgtagcacattagaagccaacaattttccccacatagagggaataatctagacttcttagaaaataataattattattattgagatggagtttcgctcttttgcccaggctggagtgcagtggcgtaatctctgctcactgcaaccactgccttccggttttaagcgattctcctgcctcagcctcccgaggagctggaattataggcatgcaccaccgcactcggctaatttttgtatttttagtagagtggggtttcaccatgttggccaggctggtcttgaactcctgacctcatgatccgcccccgcctcggcctcccatagtgctgggattacaggagtgagccactgcgcctggccagaaaattattgataaagacctacaaatacttactttgattccttgttagggttgtaagtgtatggtttctataagtggtatgtattcctgcattataagcactcgtagaaagcaaataggaaataagccatcattacagcccctaaactcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacgtatgtgttctgacaacaacatatcatttctaccgtttgttttttatgatatcactcttatactttgattacatgtcagttttcttttttcttttcttttttttttttttttttttttgagatggaggctcactttgtctcccaggctggaatgcagtggtgcaatctcagttcactgtaacctccgcctccggggttcgagcgattctactgcctcagcctcctgagtagctgggactacaggcatccgccaccatgcccggctaattttttggtttttagtagagacggggtttcaccgtgttagccaggatggtctcaatctcgtgacctcgtggtcgacccgcctcggcctcccacagtgctgggattacaggcgtgagccaccgtgcccggccacattttaaacttttttacagagacaaggtctcactatgttttctaggctggtctccaactcctgggttcaggttatcctcctgcctccgcttcctaaagtgccaggattacagtcatgagccactgcgcccggcccctattttactttgtttgcctatggttgttctgtctctgttctaagcaagaaaccagatctgattcactgaagatttccacccactcttaatttttagctgcctttccttaagaaactatgtcacattcccctccctgaacaataatggtattgaataatcaaactggaggattctgaaagagcagtacaacttgaaacattcctcctcagtgaattgattgctacctctttgtggccctaagctaattgtccaggttgaaagaaaaggtttagttttctcatacttatttcctttggataaacttagataaattataggaagtgttcttttaaaaatactggaagaagccagaagtggtggctgacacatgtagtcccagcaacttgggaggctgaggggagaattacttgagcccatgaacttgagtctagcctgggccacagagcgagacccttctataaagtaagaaaaaaaatcccacaaatattggaagtgttttatttatgtttttgagacagtatcttgctctgtcacacagactggaggatggtggcgcaattacggctcactgcagccttgaatacccatcctaaagtgatcctcatgtgttagcctcctgagaagctgagactataggcatgtgctaccatacccagctaatttttgtattttttgtagagacagggtttcaccatgttgcccaagctggtgttgaactcctgagctcaaatgatctgcctgcctcagccttccaaagtgctgggactacaagtgtgaatcactcatagctggctcaacgtgttttatatgcatgcattatgtaataaaaaagtactacgtggtatatatattatgattagttatgaatggatggttacattttatattattttaaatttcagtgcctttttaggccatattcagttttctttgtggccagatacatacatttttattatttggtatgtgtttcctcgtttggtcatagaacttttcttttttgttcccgcccctacccccacccaagacggagtctcactcacttgcccaggctggagtgcagcagctgcgatctcagctcactgcaagctctgcctcccgggttcaagcgattctcctgcctcagcctcctgagtagctgggactacacgtgcctgctgccacgcccagctacttttttgtatttttaatagagatgggtttcactgtgttagccaggatggtctcgatctgctgacctcgtgatccgcgtgagccaccgtgcccgacccataacttttctaaggaggtgtattctgttaggaatggtaattggtagggtcagtaaggtacagggtaattgaggcctgtagaattcattcttcctctttcttcattagtgggaaaggagaaaaataacatatttgtttgatgtggattgggaggagataataaattcttcctctgtggcaggagttatgggtaaatattgttggtatgattagaaagccctgctactatgagagcaccttctatatttccatttcttgggggtgttggagtatccagagaggagggtagtgtgtgatcagttattgtaaaaagagtgaaatcacttctattcccaagtaatttgaaatcaagaaagcatcacagaagtgtactgtattgttcacgtcataaatgtatagggcattgctttgcagattagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaaggtaaggctttacagaagttactgtttcctgatagctttaagaaaactatcgggtagtcctccagagtaccatttgcattcatggaatgagaacttttgtgtgtgtgtgagacattctcactctgtcactcagcctggactgcagtggctgagcaatctccgcctcctgggttcaagtgattctcattcctcagcctcccaagtagctgggattacaggttcataccaccatgcccagctaattttttgtatttttggtagagatggggttttgccatgttaatcagcctggttttgaactcctggcctcaagtgatccgcctgcctcagcctccctaagtgctgggattataagcgtgagtcactgtgcccagcctgagaatttttttagagacaacatggtctttgtctgtctgtctgtctgtctgtctctctctctctctctctctctctctctctctctctctctctcacacacacacacacacacacacacacacacacacacacacacacactctctctctctctctctctctcactatgggtaaaagtaataattttcaactctggttaatttctgtctgaagccactttttatagaaacacagtggccactcaatgttctgggcagacatgactccctgctgtctccttgggtccgtgggcatttttaaagttgctctttttgttgaagttctgtatactgagacatcagctctagcaccacgtctttttagcccctagcatttttatttgtttttgtagcccactgcactgccatagcttaatctttctgtctataaatttactatctacctctacctctggctcctagtaattttactctttggaaggttttattttttatttaaaattttttaattatattgatttttttttttttctgagacaagtttttgctctgttgcccaagttggagtgcagtggtacagtgttggctcattgcaacctttgcctcccaggcttaagcaattctgcttcagcctcccgagtaactgggactacaggcacacaccactgtcccggactaatttttgtattttttttgtagagtctaggttttgctatgttgcccagctggtctcgaactcctgagctcaggtaatctgcctgcctcagcctcccaaagtgctgggattacaggcgtgagccaccatgcccggccttatattgaattattttgatgagtcatctcactgttgaataatgaggtatagcaaacatgaacaaaggaagaggagaaagcagcaaggaagagagaaaaagctcctttttcttcaggctagtttaaaaatatacattactgtgttgcagtttcttacttgattatggctggagggagttccactttaggtcatttcacctagttgctagaactggaaacccagagctctcaaccttcagtaggcattaaaattatttcattctgtccattcctgatacagtcattgagaggttggtatgtgtaaaatccatctcttatatttatggcataagtgtatccataaagaacatatttcatatatacatattaaatacacacacacacacacacacacacacagagttatttgattagatccttggtatcatgctgtatgtaatctgcagtttggttttattacttttttttttttttttttggagacgggctggagtgcagtgatacagtcataggtcactgtaagctccaagtcctgggctcatgggatcttcccacatcagcctctggagtaggcaggactacaggcacgtgccaccatgcctcctggcctcaagcaggcctcctacctcggcttcttaaaatgttgggattagattttatcactcttaattaaatatttgagaactttcagtgctgatacttataaaagttctaacttaatccatgcaacatgtcagaattctgttttccacatgtgccagcacttactccttgatctctagtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttcaaatttttgctgcatctaaagttatctttttgtataccatcaaagtaaatttgtcatatagtaatatttaagtcaagaatttattaacttatttttaagaatctgcatatttttaaaattgttgaactgttgttattagatataatagttgcatttgaaattccgtaagttaagagattcattttatctcatggattgtttactattggtttagagttggggggcattacctttaaattgattgatgaacatgatttaaatttctgcgtttcttaaaaactatttcttatagtatcatctaccttaaaaatggaattaaaaaccatatacatatacacatatacatacatgtatacatatatatgtatatactttttttttttttttgtggagacggagtgttgctctgccacccaggctggggtgtgatctcggctcactgcaaccttctcctcccaggttcaagcgataagcgattctcctgcctcagcctcccgagtagctgggattacaggcgtgtgccacaacacccagctaatattttgtatttttagtagagacggagtttcaccatgttggccaggatggtctcaaactcctgtcctcaaatgatctgcctgccttggcctcccaaagtgctgggattacaggcgtgtgccaccacgcccagccatattttttcgtttaataagataatctccagttttgttggtgtgcttaggtattgtattttgaagattatattcaaagagcatatttattgtagcgtagcgtatatatatagtttgcattttacagatgcgtcctcattcagacttttcttagaggtaaaaaatttaaaatgtctaatgtgacctatacttaatatatggagtatatgaaaactaaaatttaagaggacaagaaaaatcttttttttaaccaaagtattattatatttattatggcatagagtggtattttatacatatctcattttacagtaaaaacattttatgtacaactgtagagagatagctgcacagatagctccaacttaaattagaaaatattttctctatagaaaataataaaaacaccgtttcccaggctagcccaacaagtttatttaaaccaaatagctgaatacatatacatttataaatatggtttgaattctgggatccaggagaaactttagtttcatttattgaaacggccatgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacaggtaaagaaggcttgttctgtggattcatacttggttttttattagctgtgtttttccatctgcacagttgataatgcatgttcactaagtggaataagaaaaacaaactttcacattctgagtaattattaattctatagctaatacactgttttcgttgggagaaaagagctatcagaaaaggataaacatttctatgcatcttttgtgcagtgggggagcccatgatagtattatatcaaacaatactatttttttctttgtgtgttgtaaataggtctgatttttaaaattttttcttgattcttttagagacagggtcttacctcggctggaatgcaggggcatgatcatagttcactgtaaccttgaactcttgggctcaagcagtcctccctctgcagtctcttgagtaggttggactataggtgtgggctaccacacctgtgtgctaggtccaatttttatagcaagttacaacgaatctctgtaactatctgggtttttctagaaattttggtcttctagcaatttgacctcccgtctctcaccccatctccaaattgatacattattgtgaagtaacagttgtgacaactgccttctctcattctttgttcccatggcattttcaaactactctcattctagtatttgtgacattatgccaaaattgcttgttttgttcttccttccatccaaactgtaagttccctggggatgtagacagtgtcttgatactattttatctctaatttgtctgacatgatacaatcatagtgaagatatttaatatagttaaatttaatacagtatagccaaaataattaaaacattggaattagtagcttaaatctcaagggtgccagggatttggctttgtagaaagtgccatgaaatcagtaaaatattgaaggctagaagcataaagtggcaatgtataacgtcaacattctgagaagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtctcgctgtgtcgcccaggctggagtgcagtggtgtcatcttggctcactgcagcctccacttcccaggctccagggattctcgtgcctcagcctcctgagtagctggggttacaggcacgtgccaccactcctgactaatttttgtatttttagtggcgacggggttttaccatgttggccaggctagtattaaactcctgacctcaagtgatccgcccatcttggcatcccaaagtcctgggattacaggagtgaaccaccgtgcccggccttttttttttttccctgagacagagtctggctttgttgcccaggctggagtgcagtagcggaatctctgttcactgcaccctctgcctcctgggcaagtggtcctcaggcctctacctcgtgagtatctgggacacttacaggcatgagcagaatgcctgactgaatactttatgcttttttgtagagatggggttttcctgtgttacccaggattgagccactgcccatgtccttttttttttctttttctttttctttttttttgagatggagtcttgctttgttgcccaggctgtagtgcgattctgcaaggctcactgcaacctccacctcccaggttcaagcgattctcctgcctcagcctcctgagtagctgggattacaggcgtgcaccaccacacctggctaatttttgtattttcagtaaagacagcgtttcaccatgttggccaagctggtctcaaactcctgacctcagatgatctgcccaccgcggcctcccaaagtgctgggattacaggcatgagccaccatacctggccttttctcttttcataaagatattttacaagaggtaatgtaaaacaaaaatcaagttgaatggtgtagagttgtagttaatcagattattgtttgggttttagatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctgtgagtaggaaattatatttcatcatattattgggaacagttggaatatgccatacaaattcatttgaagaaaaaaaaacctcatttgattctattaatgacaaataagtagggatgatcatcttgacaccaactcaatgccatggtcaagaaattagtaataatggaaattttttttgtgctacttgaagacttactaaaagcagatgattgtatcttgatacatatctgtcttagttcaacttgtgaaataacattatattttagtctcaggaaaaatcatgaagctttaataactgttatagcaagttacaattctttaattcagtaaccgtggtttgttttgcagatactgatggaacgtcgaattagaccatggattaataagaaaatcatagaatatataggtgaagaagaagctacattagttgattttgtttgttctaaggttagtcttctattctcttccatgccagcatttattttatatattaaaatattagacacttcttaaaagagcagaaattttacagagtcaagttccatgatggtttaggttcagttaagtgatttatatctgcttttttaaagttatttttatttttggtgtgtttttttttattcactgcagtggatgcagatttatgtctgctttaatgaacctttccatccaacttcagactcctcacaccacatgtttttatttcagtggtcgaggaggatggaattgctggttactgccaattgtgtgctgtctttctgcccctgagaatgctgtgccatcttcttcttgtcttggttggaataattatgttgagattttttggacgtagccaatatcttttcccaactcctttgtcagtcacccatcctttggataggatcaaaatagttcctttcatatcgtagtaacgatcagtgtttattgactgacaggctgtgttctcggcaggtattgtgttagttttgtttgttttgttttgttttgttttttgttttttgtttttgttttttcttttgagtcggagttttgctttgtcctacaggctggagtgcagtggcgcaatcatggctcactgcagctttgaacgcccagcctagactgatcttcctgccttagtatcctgagaagccggaactataggcatatgccaccacaccctgctaattttttttttctttttttgttttaaattatactttaaattctaggatacatatgcataacgtgcaggtttgttacataggagtacatgtgccatggtggtttgctacacccatcaacctgtcatctacattaggtatttctcctaatgctctccctcccctagctccccacccgccgacaggcccagctgtgtgatgttcccctccctgtgtccatgtgttctcattgttcagctaccacttatgagtgagaacatgtggtgtttggtttacaccaggctaattttttgtatttttagtggagatggggtttcaccatgttggccaggctggtcttgaactcctgacctcaagtgatctgcccaagttggcctcccaaagtgcggggattacaaggcgtgagccatcacaccagccgaagataaagttctataaaatgttaacaagacagtggcccacgccttgtaattcccgcactttgggaggccaatggggcagaacacttgtggtcacgagtttgagaccagcccggccaatatggtaaaaccccgcctctactaaaaagtcaaaaattgggtgcgctgggtggcaggcacctgtaatcccagctactcgggaggctgaggcaggagaatcacttgaacccgggaggcggaggttgaagtgagctgtgattgcgccattgcactccaagcctgtgtgacaagagtgagactctgtctcaaaataaaaaaaaagaaaaaagaaaaacttcttttaacctaacacttagaatctgtctgtcatgaatgttatacccattttatacatgaagaaattgaagtttaaggagagattgtgtcttggctatgttttatactgagtctagcctctgaaacccatgctcttaaccactaaggtatatcttcccattgtctcctgaaaacatagtcttaactttaataaaacagttaacatagtagaaacaccatatttctataaaggtatagctatggtatttttttgccagtagtgctcttttgatattatgaacagtaaatttactctgtcttctctaacttgtaattattgtggcattaaaacttgtgtgagatttgacttaaaattagactacagaccactatggagattaatattccaggttttggtgcctctttcgttgaagaatgatattctgaaaattaaaacatttatagaatggttccttagccgcaagaagttcctgtatgaatttgaggattcataccttaaaatttcttgactgtattgttaattttttatttatttttaatgtgacaattatttttctcttttaggttatggctcatagttcaccccagagcattttagatgatgttgccatggtaagttagaaattcactatttttatttcttttaatttaaaaaaagtttttggttttttttgtcttaaaatatagatggggtctcaccacgttgcccagggtagtcttaaattcctaggcttaagtgatcctcctgcctcagcctcccaaagtgttgagattacaggcatcagccaccacacctggccagaaatgcactattattaatattttaattaacatctatataaactcacttttgaatttgattcacttcctgcctgtctttgttccagaatcttttttaggcctgaattaaaacttgagtaatcccagtacttgggaggctgaggcgggtggatcacaaggtcaagagatcgagaccatcctggccagcatggtgaaaccccgtctctatgaaaaatacaaaaattagctgtgcgtggtggcgtgtgcctatagtcccagctactcggggagtctgaggcaggagaatcacttgaacctgtgaggtggaggttgcagtgagccgagatcatgccattgcactccagcctggtgacagagtgagaccccatctctaaataaataaataaggcttcattcttttccaccagttccattcatgttttccctatgcccagcacaatgtgctagaagcataaaagtagaacaaatgacctgtagtagcagagagataggtatacaggtactggaaccttgatgtacttgtttgaattagatatgtagaaaggataatggaggtagaggagatagaacatctgatggcattgatagcagttaggttaagcatcacaaggattactacaggaactgatacgtgtgtgtgtgtgtgtgtgtgtgtgtgtgtgtgtgttttaagtcggatacatgtgcaggtttgttacataggtaaacttgtgtcatgggggtttgttgaacagattatttcatcacccaggtgttaagcctagtactcattagttatttttcctgatcctctccctcctcccaccctctgccctacgataggccccattgtgtgttgttcccctctcttcgttcatgttttttcatcatttagctcccgcttataagtgaaaacatactgtatttggttttctgttcctgtgttagtttgctaaggatagtggcctccagctccatccatgtccctgtaaaggacactatttcgttttttatggccacaagattgtacatatgtgctgctttttggacaggtatccaaacacctgttgtattgacagtaaacatcaaatccccgttgcatttaatttgggattacagtcagtggtagcatgtagttaacactgtgattttgtgagacaaggaaaggagaagaaaattgatggtaaaggttgagcaagagattgaactatgatctccaagttaggaagagaagaaaatagtatctgaatagagctggtggtttgaatgaattaaggactagtggttccagtgaagttgtggaaggcgaattgtaataaaacaactgaaaggagaggttatggtcagagtgtagaaagttcaagtctatatgtgataggtcagcccagacgatggcaaggtgcatagtatgactatgggaaattcctgggtattgggagtcagattggagagaaatactggaaatagttgccagagcactcatttaagtggggggaaagactagatacttgccagatagctgctcttacagtggataaggtggtgagagctcatgaacgtccatggagttgtttttttttttaccaagaaagaaacagtgaagacccacaagtcattcctgtggagattaagacattgagagtgagagactgcctgagaagtgccggggctctaggagatagaggagggtttctgttaagaggaaaaacctaatttagttgttgatgtgtagtataaaatggaatagcggtccaaagggcagagcgggaagacagcaatgggaagatgagtaaggaaggaaaaatcatcaagcatgatatgaaatggtagatgactgggagtacttgcacttggaactgccaccagagatgtcagggagggacatcgtggggtttatagtcaaaaagaaggattgtgaggtctagctgctttgtgtccaggcattttatggtgtctaaagccagataacattccttttctgctgcctagctagcttgatgcagctgtcatttagaacacctgataaaacatttgtgaaaacttcattgcctcagaggaaaggagaaatgtgaatagatttcagtccttggggctgaattctgaactttcctgaagcttccagccccgtttttcttggagtagagggtgtcgtagttaggcctgagtgaagacattttttaaataaaactgtgttctagcgtttggcctcagcagagttcctatcatacatagtaaagatttcatgtcagtgttaattttagattttttgatctgttgtaatatattgatatttgaagtgtatttagaccactgtttatgattttgtggctcgttgattagaatgagaggaaaccagttgagctagtgttgtcaaacagctctgctaaaaagctcatggggccttgtaaatatttcttgaataaatgaggagactgaatttttagcctgagtactgtttcactcttaacaaaagtctgacttctttatattatacctttttcattttatgtaaattaaatgaagtttggttgcattttgtgcctacatctctctgaagtgtgactcagatgtgaattagtgttacaacagagttcttcaactaaagtcaaatctggctcatagaaatctgatcaaaagttctttaattaattattgctatcattgagaaagtgacagaaatttctttcttttaatttctttcttcttttcttttttttttttttttttttttttttttttttttgagacagagtcttgctctgtttcccaggctatatggagtgacagtggcgcgatcttggctcactgtaacctccacttcttgggttcaagcaattctcctgcttcagcctcccaagtagttgggattacaggtgcccacccgcacgcctggctaatttttgtatttttagtattgacgggtttcaccatgttggcccggctggtctcaaactcctgacctcaggtgatctgcctacctaggcctcccaaagtgctgggattacaggcgtgagccactgtgcccagtctcttcccaggtatttattaagcacttgttatataccagtcagttgtcagagcacttaactacataccaactcttttaattcccacttagtacctactgctatggtgtgtagctacatcgcctccactttagaggtgagggaactgaggctcaggttaagtaacccaaccaaggacctatcgctagtaagaggcagcagtgcaatttgaacctatgtagcctgactagagaatttgaaccaatgtagtctgactagagattgagtactctaaattcctaccccaaacttcctctatgaagacctggcaacactagaccacatttctggagcacagtcatagctgcccccttcagaagggagcagagtaggccatttcacctcatagcagccataatgtagaggggcagatgtgtgtatgggatgatggcaggaatagtgatggggacacaaggaccctataactcataagtagagaggaagacaatttcctcatccaccactggaagaagacttgttactcagtagtcatgtgtgccccgtgatgattgtatttgcttattgtgtttactgtattctggacactgtactaaatacttatattctcatttaatgttcactttagtgtcacatacacaataaatgctagttaagatggtacggttgggctgtgcacagcagctcaaacctgtaatcccagcactttggaaggccaaggtgcgcagattgcttgagcccaggagtttgagaccagcctgggcaacatagtgagaccctgtctctactaaaaagcacaaaaatgtagccaggagtagtggtgcacacctgtagtcctagctactggtgaggctgatgtgggagtatcacttgagcctgggaggtcaaggctgtagtgcaccatgatcatgccactgtactccaggctgggtgacaagagagatcctgtctccagaaaaaaaaaaaaaaagtttgtgaggttgtgtttttggagataaatgaaattctgtattgttattatgtaattgtatattatttagttcttcttaaattactgtgttctttatgaaaagcgtatggtttccttgggaagtagttttgtcagacatgtataattgcagtatctgtaaaggtaaaataaaagaataaaaggtggatcacaaaaatatggtactctttgtgtttagtaagccatggaattttgaatgatttttttttgttgtcgttgttaatttacatttactatttatttatttatttagagacggagttttgctcttgttgaccaggctggagtgcagtggcatgatcttggctcactgcaacctccgcctcccaggttcaagcgattctcctacctcagcctcccgagtagctgggattacaggtgccggccaccatgcccagctaatttttgtatttttagtagagatggggtttcgtcatgttggccaggctggtcttgaactcttgacctctggtgatccacctgcctcagcctcccaaagtgctgggattataggtgtgagccactgtgcccggtccatttactatttattaataatacatttctcacactggacaaattttctttaagtcattttactgaaagcaaaactacttcctaaggaaaacaaatacgtattataaagaacgtagtaatttaagaagaactaaatatacaactatgtaataacaatacagaatctcatgtatcccctcaaaacaaccttaaaacttttttgttttttttgtttttcttttttgagatggagtcttgctctgttgctcaggctggagtgcagtggcgcgatcttggcaagctccgcctcctgggttcacgtcattctcctgcctcagcctccccagcagctgggaatacaggcgcacgctgccatgcccagctagttttttgtatttttagtagagatggggtttcaccatgttagtcaggatggtcttgatctcctgaccttgtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtcagagttggttgatttttagaattgtatatataaagaattagacattaaacaggcatattctagtgtctgaaaatacacataagaaatttctattaagttgcttgaactttgtgggttaattttaccataatctcataaattaattttagtttgaaaaccttatacagtatgaattcattttgccatttcaagttgttatataaagagcatgaaagtctttttttgttgtttttttggggtttttttttttttgagaggaagttgtgcttttgtcgcccaggatggagtgcaatggcgcgagctcagctcacttcaacttccgcctcccgggttctggagatattctgcttcagttttctgagtagctgggattacaggtgcccaccacgacacctggctaattttttgtatttttagtagagacaggatttcaccttgttggccaggctggtctcaaactcctgacctcaggtgatccacccgcctcagcctcccaaagtgctggtattacaggcgtgagccaccttgcctggccaaagcgtgaacatcttaagaaccagtcttgatctggcaaaaaagtagtagaatactacttttctttatttgtccctaaaaataaagtatgtacatctgttcacaaggaagaaaggtaagtttgaagttgtttttcttaaactttaatgtgaccccaaatcatctgaggagtgcttgtagaaatagagacactgaagtagcagcgctggggtggcgccgcaggctttgcatttctggacagctcccagctaatgtcattgccaactgatccaagactacattttgattagcactttaaggtgtctattcagtattattttatcctaacagactacataaatgcagctgaattttcctttaagtagattttaaagagaaaaacattttttgaggcaaatacacgtaactcatgaacgtaatgtaatcttgcaaaattatgtctgagaaagccctaatattctaggctttttttccatccagccctgaaaattttttctgtagataactttatgttgtaacttattctgaatcttattatggcatttccctgtaaactatgtaagtgtaagctaatgattattttgtgaagcgtgctgtttcaggtattaatctgccatgaatactagatatagtagaaaaactgagaaaacatttagcttgagagccaatttgaactagacactatctttttttctcctttttaatggaataaatttaatgcaaataagtgtaagcaggtatacaatgtttagatgaggcttattttcccaactctttttaacaggttttatgatatccccaatttatacccaaaagactgctgagaggttttatgtcaaattgattacaaacttctctgggttgtatttcagtcttctgttaagtatgaaattgagaaatagttttgctcaacaaaagatgatgagggattgatttgtgaatgtcactggagataaaagggtatgagaaggaatcccaagcaggcaaagaaacagtctagctgtcaagaagaaaacagggagatacataccaaacccaggagctactaatataacaatcatactatagagcgaagtgaacttacactttttgataaactgatagattttttgtaatgtgattatggtaaaatactgaaatatttatgttaatttatttgcatttgaatgcttacatttttaattgacagaatctttgcatttcattacttgagtcatgaaggcgaaattaaagaatggcagtctaaaatacccaggtaaagaagataatttctagaaacaaaaataaaaattcttttcaagccatgttgtttgaattaaatgaca

SEQ ID NO: 15 - DNA, 7615 bp, Artificial Sequence
  Based on Homo sapiens sequence
agtctgaccttccctcccggcagcagcatgcgggggttgctggtgttgagtgtcctgttgggggctgtctttggcaaggaggactttgtggggtagggatgtggagaggagggggtgccctctgagggtgatggggaggactcagcccccaaccagtagaggagacagacagacagatacatggcaacacagccagagaggatggcctggcaccacctgggacagctggcagataagcaaccagggttgggaagaggttgtgtctcccaagacagtctcctgagccctggagaaacctgagctctgaggaggagttttcaggagaggagaaaggaggaggcctggctggcttggaacagagaaatagtccaaactgggattgagatagtaacagcgtctagaagtttctaaagatggggagagaagaggtgagggagcccaggcctctccttgttgagacccttggtgctgtcccctgcccagcccagaggacgaggcccagtctggggattctgggctgctgcctccctcctgcacctggggagtgcttgtggccagggcaggtgcagcttgggtgctcactccccactcccactctgcccaggcatcaggtgctccgaatctctgtagccgatgaggcccaggtacagaaggtgaaggagctggaggacctggagcacctgcaggtcagaagaggggagaagggctctctgaggccccagggtatcagctggggccaccccaggtccccagcggccaactgtgcctgggctgtctccacccaacaaggagacatggaattgactctgttaggaagcgacttcaagcccccagctccagagccttgctgcccttgagcacctgggcaaggggccgggcccctttccagttcctccctctgccttgctgtctcaaaggcccctcactctgctcctgggccatttccctgaccacactggactctccagtccccagggtttccccgtatttctctggccctattacccctgacctatccccaattatatgagaacttctggcaccaacagcccctcccacgcaggccctgtccctgcctgctgtcctggctggtgcccccagcccgctgtgaccgtgccggctcttgtcctccccagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggaggtgagggcgcccctagcggccgctccctgcagccaccagctcttcatcatggctggtagaacgcggtagggccaaggccagggccagcctgggtgtgcgcagcgcctgctctgtttccatgtggcctgtgtggtcgtagctccattgcagggctcgcagcaggctgggacggtggggctgctaagggaagcatctgggtgcccagaagctattaaggccagtggtctcttctttcacacctcagatctatgacttcctggacctgctggtggcggagaacccgcaccttgtcagcaagatccagattggcaacacctatgaagggcgtcccatttacgtgctgaaggtaacatccacatgtggacatacacaggggagaatggacccacacgtggcatccgtgatgggcgtgggctctcccggggaaatcatggtaccagggaacacgctgttaaatggactccccatgcagacatttggaaaggcctgagtctccaccctggtcttggcgtgtgcactcctgcccatacacaaagacaggtgatccagtgtttccaatcaagtgtccattgtggaaggtactgtagagtctgggtagtccagataaagtattttcttgagacagagtctcgctctgtcacccaggctggagtgcagtggcatgatctcggcttactgcaacctccatctcctgggttcaagcgattctcctgcctcagcctcccgagtagctgagactacaagcacgtgccaccatgcccgggtaattttttttttttttttttttttttgagacagagtcttactctgtcacccaggctggagtacagtggcgcagtagcgtcatctcggctcactgaacctccacctcctgggttcaagcgattcccctgcctcagcctcccaagtagctgggattacaggcgcctgccaccacgcccggctaattttttgtatttttagcagagacagggtttcaccgtattagccaggatggtctcgatctcctgaccttgtgatctgcctgcctcggactcccaaagtgctgggattgcaggcatgagccactgcgcctggccaataatttttatatttttagtagagacagggttttgccatgttgccttggctggtctcaaactcctgggctcaagtgatctacccgcctcagcctcccaaagtgctgggattacaggcgtgagccaccacgcccaacccagataaagtgttttgtttgtgatgtcccccagagaactgtccgagcagcagaacaggggaagggccaggggcctggtcaagtcatattcaccccaagcttgggctgagggcaggaggccaagctctgtgggatccctgtccagcccccagccccaaacccacctgagtgatggccccacaagcagagcctctacctgagatacacagagagcaggtggtctctggcccaggtcggggtctccttcagggcagcaagatgaggcctcagctgtgaaattgcctctgatcactcccctgcctcctctccagttcagcacggggggcagtaagcgtccagccatctggatcgacacgggcatccattcccgggagtgggtcacccaggccagtggggtctggtttgcaaagaaggtaaggccggggaggtgaggagggctctcacctggtggggcattggtgtccaaggcccacagaagcccgggcctccctttgcccatccagaagcagtgaccacagaggacatggggaaaggtgtccattgctgtggcttggcagatgcctggcccagcctgcgctgcccctctgctcctctaaccccccagatcactcaagactacgggcaggatgcagctttcaccgccattctcgacaccttggacatcttcctggagatcgtcaccaaccctgatggctttgccttcacgcacagcacggtaccggccttctcctgtccttgggggaagcaggatgggcctctggcttctaagctgcacaagtagttcacccctaatctcaagccccagaagtcaagggaggggcaatcagacctgtgctcctagccgagggtgtctcaacagtggcgtgattggcatttggggtgaatgattctttgtcatgggggctgtcctgtgcatccacggtgtttctagcatcctaaccttacacccattcaatgccagtaggagcccccctctccagtggtgacaaccaaaatgtcttcagatattgcaaaatatcgcaggggagggtcaagattgtccccagtggaggcccactgccccagaccttacttcctggtcctacttctatttttacggcaaataaaacatctgaccaatgacatggggccacagtggtggtggaggacacctcgcagcttcttcgccatatagaaccctctggccaaatgccatcctatggccttccccactctctttcacccgatgccccctctgctgatcttcctccccgacaaccagctgggagtggatcccatcccaagctgtgcctgcagctcagcttccaatcagggcacttgtgttgagggcttccacctccagggagccctcccctcagtccactctgctctctgcagcctctgaaccaccccccacccagcactgtgacaagcgtcacacgtgcctcggggtggctgatcccatttccttcctcagaatcgcatgtggcgcaagactcggtcccacacagcaggctccctctgtattggcgtggaccccaacaggaactgggacgctggctttgggtgtaaggcccagagtgtcttgggagcaaggatgggatggcctcgaatggctcctcaccactgctcttgctccccgcctctctcctgcccctgcagtgaggggagggttgggggtggcagctctgcctctgagggctcttggggatggaggctgtgctctgagagttggttgttactcgcctgcaaaaggcaagttgcttgcaaatgggctaaggtctgaaatcctacctagggggcttctagcttaacctcaagtcctcccgccttggccacgtctctgtgagaactggtctccactgaggagcccgtcttccctccctgggtgtgtccatcagctctgcccaaaccaggctgggagggcagttcccccaggttatagaaggcctttgggctttcctgaatccaggggtgggagtgagcccttccataccacctcacccccaactccatgcaaagaactggattccagaagccacagaagctggaggagccacaccgccatgccctctgtccccccacagtgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggtaggcactgacctcggcttgccccctcgtccccaaggtggcttcggacaggcccaggctttcccccatcagacctgcttaaggcacagacacctccagagtacctgacacccttccttccctgatggcttgggaagaccagcgggtggactaaccattttttctgggaaactgaggcacaggagtgatggagtcacttctgtaatgtgacagagcaaggggcagggctagacttcgatcttaggcaccacatgtggaggtgcatgtgcctgaagggcagggaaggccagccggacaccctgaagggccagaaaactgtgctgacaggctcccgggctgagcttccaggctaagcaggctctgtgctccctgctggaggcccacttctgcagggtgcttctcctaggctcccctgccagcccccagactaccctggacatgctgttccaggagcctggccatgacaggtggctttgcttggtgttttgtccaggatcagctttccaaggctgctgtgacagccctggcctctctctacgggaccaagttcaactatggcagcatcatcaaggcaatttgtaagtggccgtagggtctctcttgatgggcctgcgaggaacatctgctggctcttcctgaccgagggagtatccctcatggaaggaagtagccaagggcacccagatctgtcaactgctggcaagggctattctgaggggtgggcagtcccttttcctgacatgaactctgcttcctttgatactttcagacaaatgtgaattcctctgacagctcttgtcctcttgtgttggggccaagtctagtttcttggttggatggggtggagagtcctgctgggatttgcagatcaccaggaaattcaacttaaaaaaacacttctcgggggcagggcaccgtggctcatgcttgtaatcccagcactttgggaggctgaggtgggcggatcacgaggtcaggagatagagaccatcctggctaacatggtgaaaccccgtctttattaaaaatacaaaaaattagctgggtgtggtggtgtgcgcctgtagtcccagctactcgggaggctgaggcacaagaatcgcttgaacccgggaggtggaggttgcagtgagccaagagcacgccactgtactccagcctgggcgacacagcgagactccatgtcaaaaaaacaaaaacaaaaaccacttctcctccagtgcccctcaattagacaataggcctgatttattcctcacttacttattcatgcagtgcccctgagaggagcattactgaatcaaaatggaattaactcaacaaatgtttattgaacacctactatacaccaggccctgtttcatgtacttgggatatagccatgaatgaaataagcaaagatcagggaactttctagccagggagaccaacaatgaacataaataagtaaatgatacagtatgtgaggtgacgaatgctggggaggaaaactaaaactagaccaggtgaggtgaatcgggaacactgggggtggaggtggggcaggtgggttgaagggtgggcctcattgacagagtgacatttgggcaactattgaaggaagtgggtggaggaggtggcagccaggaggctatccagctaggaagagccttccaggcagaggaacattctagagcaaaggctctacagtgtggtctggccggggatgttgctggaacaacaagactggtgtggctgcctccaagtaagtgaaggtcaaagctgggtagaaggctgagggggcagggctgcgtacacacctcacacgcttcctgcctgagtgcctaggccttggtgggcaagcaggtcacaatcttatccaaggttgacctcacttttggactccaggccttctttggaaactgattcaactctgagtcaaggttttgcttcattcaacatggtcaagttaaattctgatatgcagcctactgctctctcctgggccaattcaaaagtggcttcattacccactgttaattacagtttcccgggcaaagtttcctcctaaaagaaagacaaggggcttttgctttgactctggctctttgcactttccccctcacagaccagagccccaggggaacaaatcctggttacccaagcagggaactcggtatatttaggggcttcaccgaaagggctgttggacagaggctgttttcagaggggcttgtgcaattgcagagacttccttgcatcccctagtgaataggggaaccattgctggtctcctctttggacctcttggcttagaccttttagtgggagtttcttggaagtgaggctgcttggtcaacagcagaccttagtagacactgactccactcagcattgcacaaggcacagagctttggacagggttggatcgttaacccaacccgtgtaaatattcccaaagtgattgaccctttctctcctattttactcctgccccagatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgca

SEQ ID NO: 16 - DNA, 412 bp, Artificial Sequence
  Based on Homo sapiens sequence
acagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggccccca

SEQ ID NO: 17 - DNA, 10886 bp, Artificial Sequence
  Based on Homo sapiens sequence
cctatcatcacaaaactcatgatgctccggctgctcagttccctcctccttgtggccgttggtaagaccccaacctgtctgtgtgctccctgggctgccctggactaggaatccttgaaatctaccactcgctctgagtcccatgacatgctatgcctggttccacaggagggggtctcagcttgtacccgggggcatgactgtaggggctttcagcttatgatggagcaggagagtggaggggaagctgtggatggtgaaagacccccaaagggctgtggtggaagtccttgatgggggcagtaaacaaagtcaaacggttaagagtttggactgtgtggttggacttcttgggttggaatttccacagttctacttaccactccaactctcctctcactccccctacctggctccatattctatgctctggccttttcctggtctctctgccatattacattccagctcagggccacctcttccaaacagcctcccttgactgacaataatggtaacagataacattgattgagtgcttactatgccaggcagaatgtttagggattttcttatactttctcatgtaattctcacaacagcctcaggagatcagtactatcattatcccccattttactgaccctcaaggaagtaaagtagcttatcatagaacaaaaggcagagctgcacttaatgtttttattttttgctttttttttgtagagatggggtcttgctttgttgcccagactggtctcaaaatcctggcctcaagcaatcctaccaccttagcctcctgagtagctgagattataggcacatgccaccatacctggctactttattttattgtactttatttttctagagatgaggtcttgctatgttgcccaggctggtctcaaactcccgggctcaagcgatcctcccgcctcggcctctcagagcactaggattacaggtgtgaaccaccacacacagcccagagctgcactttgaacccaggaagtccttctttaaagcctccactctgtatgacaatagctctcactttttgagggctcatcgagggccaggcattgttctaagtgtatcaagctcttcaatcctcccaatgaaggaggccacatttgaatctctatccctggactcctgggattctggaaagccctgctctagtttaaatgttcactgttcatatgtggttactgaggtccagagggcgaaaggggcttgcatggggtcacacagccagttgaaggcatggcttggactgggaccctggcctcctctttgcttttggggaccctccagctgattgacagctctcctctcccctctagcctcaggctatggcccaccttcctctcactcttccagccgcgttgtccatggtgaggatgcggtcccctacagctggccctggcaggtaagagcaatagcagctgccctcattcccaccgtgggctctggaccctaagctctaatggcgtggcatccagccttgacaccattgctccctttgcaatgtccacttcagcttccaaagaccaggcagcccttggaccatctacttcacggggaggttttgcccgtttcatctgtaaccctcactgggctatttgcaacttaaaattggaatcgggggtgaaggaaatgctaaactcaaggagttggcacactgatggtggaatttcaggcactgtgttgacgaagtgagattttgagagactcatttctagattcctaggatgatactacagggctttgaggtctgaaagcaataagggagtgagggatcttgtaaggccagtggagggaagctcagaaggctggacttgatgtgctgtggctatttaaatttaattaaattaggccaggtgcggtggctcacgcctgtaatcccagctactcaggaggctgaggcaggagaatcccttgaacctgggagttggaggttgcagtgagacaagattgcaccactgcactccagccccgggcaacagagtgagactctgtctcaaaaaaaaaaattaaattaaattattattactattattattgagacagagtttcactcttgttgcccaggctgaagtgcaatggcacaatcttggctcactgcaaactctgccacccgggttcaagcaattctcctacctcacctcccaagtagctgggattacaggcacgcgccaccaagcccggctaattttgtatttttagtagagacagggtttcactgtgttggccaggccagtctggagcttctgacctcaggtgatccacctgcctcggcctctcaaagtgctgggattacaggtgtgagtcactgcacccagctgaaatttacttacattaaaaatgttaacaattcatttcctcagtgcttttttcttttcttttcttttctttgttttttttttttttgagacagggtcttgctgtgttgcccaggctggagtgcagtggtgtgatctcagcttactgcagccttgacctcctaggtccaagcaataatcccacctcagcctcctgtgtagctaggactacaggcatgcgccaccatgcccagctaatttttatacattgttgtagagatggggtctcactatgttgcccaggcttgcctcgaacttctgagctccagtgatcctcctgtcttgacctcccacagtgctgggattataggcgtaagccaccatgcttggcctgcttgccacatttcaaatgttcaatagtcacatgtggctagtggctaccatattggacagcaaagatatagaacattcccatgattatgggaagttttatcggagagggtcagcaggcttattctgtaaatggccagagagtgaatattttaggttatttgatggtttggatagtaatgacttgactgtgccatggtagcatgaaagcagacacaaacaatacagaaatgaatgtgactatttccaggacatctttattacaaaaacagaccagaagcctgatgtgccccactgtccacagtttgctaaccctggtctagatggagcttttgaaaatcagaatgtgtaggaaatgggaagagaggcaaagaactcatcagggtgagctgtgcttcagaaggctcaagaggccttgaaagagctgaggttcaaaagagtcaggggggctgggcgcggtggctcacgcctgtaatcccagcacttcgggaggccgaggtgggcagatcacctgaggtgaggagctcgagaccagcctggccaacatggtgaaactccgtgtctactaaaaatacaaaattagccaggcacgacggcaggtgcctgtaatcccggttactgtggaggctgagacaggagaatcgcttgaacccgggaggcggaggttgaaatgagctgagattgccaccattgcactccagcctggggaacaagagcaaaactccatctcaaaaaaaaaaaaaactcacagggcgaggggtgcgtgatagaacagagggccttcaagggctgttaagagacagaaggtagagaatgttggggtccccagggaggtcatagtgctggtgtggggaggctttggagaatcagaatgtgacccccatggaaaagtgatagggccaccacgggcagctgcccaggtcgcaggttgtatgctgcatatttcagtgggtgctctcgttttccatgtgaatggcgccctctagagttgcacagtgcacaacctatacagccattggtggcaactctcatggtggggcccagcccactgaggccctttcctcctgggccaccaggtttccctgcagtatgagaaaagtggaagcttctaccacacgtgtggcggtagcctcatcgcccccgattgggttgtgactgccggccactgcatctcgtgagttctctaccctgtccctgcctgtggccctgggcagcgggggagagtgggtgatgatggggaaggagggaggtgagccagtcaggccccgactgacctcacctctgcctgcaggagggatctgacctaccaggtggtgttgggtgagtacaaccttgctgtgaaggagggccccgagcaggtgatccccatcaactctgaggagctgtttgtgcatccactctggaaccgctcgtgtgtggcctgtgggtgagtgaatgctccggtctggaacccaggggctcctctacttgtccctccatgacccacagccaagtctgagtaggctccaactctgagtagggacgtagggacatagggacatagggacaggggagctgagtccagcagcctgtgcccaggtcccacacactgaggattgaagccagcagagcctttaaggaccatcaccaccaaacctgtctccctacagaggggatggcagtgttcagggaggggcaggaactctgccaaggccacttggctagtggcttcagagctcagggttcctctggcatccttcccccatatccgagggtttctccattcaatagatggctcacccagtgcatcctgggctcccagcactatgggcaaaaggaggagcactgggctgagagtcaggctctggcattaactctgtgtatggcctgagcaagtcactggccttctctgggccttagttttgccatttgtcaaaaggtgaccatgaagttgggcttcctgggtggtgtgaaggccaaggagacaatcttatgcctttcaagtgtatgaaaaaatcttaacaaatattagccaggcgtggtggcatgagcctgtaatcccagctactggaaaggctgaggcaggagaatcacttgaactcgggaggcggaggctgcagtgagccaagatcatgccactgcactccagcctgggcaacagagcgagactctgactcaaaaataaataaatgaataaataaaattcctcagccttaagaacgatttgggccaggtatagtggctcatgcctgtaattccagcacttcaggaggtgaaagcaggaggatcccttggcccaggaggctgcagtgagctatgattgtgacactgcactccagcctgggcaacagaccgagactctgtctcaataataataataataataataataatgatgatgaaagagtggatttggagggtaaagaagttggggcatctcagaggtggaatagcctggagcaacggctagaaggtaggacttgggccggctggaggaccaggccccgtgactgttccctcctccccagcaatgacatcgccctcatcaagctctcacgcagcgcccagctgggagatgccgtccagctcgcctcactccctcccgctggtgacatccttcccaacaagacaccctgctacatcaccggctggggccgtctctatagtacgtgctgacttctctagctggccacagagacagtggcagaaagacagggcctgggggctgcaggttgaaggtaacaccaagaccggaccttgtacttttctcccatttctctccagctgcagccttcttccatcaacctccaaaacacgaatgtggtcaattgcacatgttttggtatcttctgtgtgccacgtgctagggatgtaatggtgcacaaagcatgcaggaccatttagcgggtgggaggagagtcctcatcagggcagaagaactgtgggccttgaatgcccccttcctctggggcacctagcggtgtgcccccagacccctgactcggtgctttttatccttgcagccaatgggccactcccagacaagctgcagcaggcccggctgcccgtggtggactataagcactgctccaggtggaactggtggggttccaccgtgaagaaaaccatggtgtgtgctggagggtacatccgctccggctgcaacgtgagtcagctcttacctgcccgaggtggtgctgggtgtgcaggaccttggaatggggccaactgcctggaaggtggaggaaggatcttgcctgcttgccccattcagcctccaggccaggcaggacttggaggaaatcagcgcagtccagacacagagcccaggcctgggagtcaggacccccgggttgcagtctcagctcacacactgacatgacttgggacaagtcactgtgtctccctggtcctcaggcttccgcatcagcacagcaggagatactggtcccatgacctctaacgcaggtcaattctgtggttctaaagttataattaaccattaagaataccatcattgttctgggcacagtccctcctgcctataatccaagtgctttgggaggctgaggtgggaggattgcttgaggctaggagtttgagaccagcctaggtaatatagtgagatgcccatctacagaaaaactttttttacttagtcaggcatggtggcactcgcctgtagtcccaactacttgataggctgaggtgggaggattgtttgagcctgggagttcaagctcacagtggctatgatttttgccactgcacccaagcctggcgacacagcaagacgttgtctcttttttttttttttttgagacaggatcttgctctgttgcccaggctggagtgcagtaatgccatcatagcccactgtagccttgccctcctgggctcaagcaaccctccaatgtcagcctcccaagcagccaggagtacaagtgtgtgccacaatgcctagctaatttttaaattttttgtagagatgaggtctcaccatgttgcccaggctggtctctaactcttgggctcaagtaatcctcctgccttggccttccaaagtgttatgtttacagatgtgagccactttcctggccaagaccttgtctaagaaaaaaaaacaaaggctgggcgcggtggctcacgcctgtaatcccagcactttgggaggccgagccgggcggatcacgaggtcaggagatcgagatcatcctggctaacatggtgaaacctcgtctctactaaacacacaaaaagttagccgggtgtggtggtgggcgcctgtagtcccagctactcgggaggctgaggcaggagaatggtgtgaacccaggagttggagcttgccgtgagccgagatcgcgccactgcactccaacctgggtgacagagcgagacgctgactcagaaaaaaaaaaaatactatcaaataccctcattgtattgtaattgagtatgaattaataattaactatggtgccactaataagaactatgtttatcgagtgcttcttctctactggatatcgtgctaagatcgtgcatcatctcatgtaattccctaggctcttggacagatactactattccctatcacaaatgagtcagctggctgggcgtggtggctcacacctataatccctttgggaggccccggcaggtggatcacctgaggtcaggactttgagactaacctggccaacatggtgaaatcccatctctattaaatatggctgggtgcagtgactcacgcctgtaatcccagcacttcgggaggctgaggcgggcggatcacgtggtcaggagatcgagaccatcctggctaacacggtgaaaccccgtctctacgaaaaatacaaaaattagccgggcgtggtagtgggcacctatagtcccagctacttgggaggctgaggcaggagaatggcgtgaaccctggaggcagagcttgcagtgagctgagatcctgccactgtactccagcctgggcgtcagagtgagacttcgtctctaataaaaaataaataaataaataaacaaaaattagccgggtgtggtggcaggtgcctgtaatcccagctacttgggaggctgaagcaggagaatcacttgaacctgggagccgggagacggaggttgcaatgagccaagcttgcgccactgcactccagcctggacagcagagcgagactccatctaaaaaaataaaaataataaatgataaaaaaatgagcgagctaaggctcagaggtgtcaagtaatgtcagagtttcttgaaatccctagaattcagaaccagttccgtaaacctcagacatggctcagccacccactcctctctgacggttccagggtgactctggaggacccctcaactgccccacagaggatggtggctggcaggtccacggtgtgaccagctttgtttctgcctttggctgcaacttcatctggaagcccacggtgttcactcgagtctccgccttcatcgactggattgaggaggtgaggagggcagggcggcccggagggctttagggtggtggctcttctgagaggtgacaggtgagaaacatcggatcctggggagggcctgaaaggatcctagaagctcagtggggaagggcccttggggacattccagaaaggcttggggatgttttctgatacagtgtgaccccaggaacttgatggcttctgggtggtgcttggaactacagctgaacttccttatttcaacaagtatttataaagtatctcctctggtcttgtcctctcttgtcagggaggatagagagacatgccagacaagaggctgcctggtgggggacaggtgattacatgaatgagaacgatgcagtctgatgagagccgagagaggggagtccaggccccagacttcatctggggatgggtgatcagagaggactaataacgctcatggtaacagtaatagctaaacaacaaaaaaaaagagagtaatagctgggcatggcatagtcatgcctgtaatcccagcactttgggaagcagaggcaggtggatcacgaggttaggagttcaagaccagcctggccaagatggtgaaaccctgtctctactaaaaatacaaaaattagccgggcatggtggtgggtgcctgtaatcccagctgcttgggaggctcaggcagagaattgcttgaacctgggaggtggaggttgcagttagtcgagatcataccactgcactgcagcctgggtgacagagcgagactccgtctcaaaaaaaaaaaaaaaaaaaaaagagtaatagctagctgggtgcagtgatgcccacctgtagtcccagctacttgggaggctgaggcaggaggatcggttgagccctggagttctgggccatagtgcgctatacccatcaggttctgcaccaagtttggcatcaatgtggtgacctcctgggagtggggaccaccaggtggcctaaggaggggtgaactgtcccaggtcagaaacagagcaggtcaaaactcacatgctgaaaagtagtaggatcacacctgtgaatagccactgtactccagcctgggcaacacagcaagagcctctctcttaaaaaaatgaaaataaactaaataaaataaaacagtagtgcttgctttggcagcacatgtactaaaattggaatgatatagagattagcacggcccctgcgcaaggatgacatgcaaagtcatgaagccttccaataaaaaaacatttctggtcgagtgcagtggttcatgcctgtaatcccagcactctgggaggccaaggcccatggatcacctgaggtcaggagttcaagaccagcctggccgacatggtgaaaccccatctctactaagaatacaaaaaattagccgggcgtattggtgcatgcctgtggtcccagctactcaggaggctgaggcaggagaactgcttgaatctgggaggcggaggttgcagtgagccgagattacgccactgcactccagcctgggtgacagagcaagactccatctcaaaaacaaaaacaaacaaacaaacaaaaaaacagtgatgatttatagaccatttaatcccttggttccctgacccatgttaaaaaaatatatatataaggccaggcacggtggctcatgcctgtaatccaagcactttggtaggccaaggcaggtggatcacaaggtcaggagttcgagaccagcctggccaatatggtgaaaccctgtctctacaaaaatataaaaaaattggccaggcgtggtagtgcgtcgctgtaatctcagctacttgggaggttgaggcagaagaattgctcgaactcaggaggcagaggttgcagtaagctgagattgtgccactgccctccagcctcggtgacagagcaagactctgtcttaaaaaaaaaaaaaggccgggcgtggtggctcacacccgtaatcccaccactttgggaggccgaggtgggcagatcacgaggtcaggagattgagaccatcctggctaacacggtgaaatcccatctgtactaaaaatacaaaaattagccaggcatggtggcgtacgcctgtagtcccagctacttgggaggctgaggaaggagaatggcatgaacccaagaagtggaggttgcagtgagttgagatcgtgcactccagcctgggcaacagagtgagactctgtctcaaaaaaaaccaaaaaaacaaaaaaaatatagattttgtttatatatatacacatacatacgtatatatatatacacaaacacatacgtatatatacacacaaatacgtatatatatacacacacacatatacacacacatgcatatacatatatatatacatacacatcccatctaaatttgtgctgggcattgtaaagagaaccttagttaacaatttaatcaagaacccccccatgaggtaagttctatccctactacatagaggaggaaactgaggctcagagaggtcaatccctctcccagggtcacacagcagggctggaagttgaacccagtttcatctgactccagaacctgtgctcctaaattgactattctgtctgcccccccaacttttccagaccatagcaagccactagaaccaaggcccagctggcagtgctgatcgatcccacatcctgaataaagaataaagatctctcagaaaattccaa

SEQ ID NO: 18 - DNA, 21925 bp, Artificial Sequence
  Based on Homo sapiens sequence
gcgtgtggaacctgacggaactgccacggtgagtcgggaacatgttttccaggcctaattgatcagaatgtatccattttcccccagaggtctaaatgaactaaaacttgccgatcttttaaaaacttagccagactcaatcatgtttttaatttcgtgtagatgctgccactttggactctttcactgctgctgggagcagtagcaggtaagaaaacaaataaatgttgagctgggagagattcacttttcaacacggtcaggagggctagggcagctgaattcaggccgcagtaataacatgaagatttacttcaaggagtaaagcacaggagacgcataagagcacaggtacatggagtagggttgtcagaaaacatctaagatgcccagttaaatttgaatttcagataaacagcaaatatttcccacaaacaacaaatatgtgacatatctatactaaaacattatcatttatctgaaattcaaatttacttgtattttgatttgctaaatctagcaaccctgacatcaagtcaagttaagagtttgaaccttggctccaccaccacctacaactgtattaccctgagcaaaattcttaactcttctgtgcttcagaatctttgtctgcaaaatggggagagtcggattccccatctcctaggattattgtgagaattaggtcagattagtaaaccatccaacccagcacctgacacatggtaagatgttgagaaacgcagcccccacaacagctgctactcttactcctaccattaatctagatttatcctccttagagaagagaacccttctttgggttatttttttatggagtgacattcaagcctagagttgtgttaaaccatggatttttggtttggttgtttgtgaacagcttcttcatcacaggaatgaagatgtcctgcagtacagcaaggatggggatatacggttttggcctttccataaaattttagctctcctttcaaagcccacagctaaacagtggctacaagaagttaaggcttagggacacagggctgtccctttcttgagcacctatagcccaaggaagatatctgagtttagaggctaaaaggagtcccacgttgggattgggcagagacacaaggggagtgaagtgatccatgtggtagaattgaggaacaagaacaacagcctgtctggaatagttgtgttgtcttttgaagctgttttgtgagtgtgtggctaggagggtgttgagagtagcagaggaggaaagtctaccacacagtgtaattgaactcatatattggcagacagatcattaaaaagagcatgtttgtaaaactaatatccttctgggggattgcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagtaagaactatcactgtgtttagaactaagttctttgggaggccgaggcgggcggttcacgaggtcaggagatcgagaccatgctggctaacatggtgaaaccccatctctactaaaaatacaaacaattagccaggcgtggtggcaggcgcctgtagtcccagctactcgggaaactgaagcaggaggatggcgtgaacccgggaggcagagcttgcagtaagccgagatcgcgccactgcactccagcctgggcgacacagtgagactccatctcaaaaaaaaaaaaaaaaaaaaaaagaagaagaaccaagttccacctgttttctgtaataaggatactgaatattcaagttcttaagagaaaaaaatcagccgtgaaatttgcatctttgtagatattcagggcactgagcttaggtattacttaatgtaaattgtttataaaagattcattaacttcatattattcttgtccttcctctataacatttaataaatattgtaaatgtagggctatatttatacatataaagtatataaacattcccaatattatatatttatgtaatctcctattatatatatgtatctctacatagataaagacatataaaaatacacacacgcacacacacacacacaaagccttccattgtatgaagaaaagatcattaccaccaagattataacagacatattatcccaagttgaacaatggcaaacatgttgtgatgactgggaaatggcaacatgatgatgatagtgaatactgtggttgctatggaggaatcattattcacaaggatcctgaatcctagcagtcttctacttactgcccctctccatgtacaaatggttctattggctactataggaaactgacatgaaacacttttctgtctaaacaggaagttgccgcagattcatcaagcatcagtggctccaatttcaaaacaaatagaaaaactcgctttattattcatggattcatagacaagggagaagaaaactggctggccaatgtgtgcaaggtgagatgtggtcatctctcaaggaaagatcgtttccaaagtggtaattaacaaacggtaaggcactggccccgaccaatgaggacagtgcttggaggtcttggaggatattcagacccctgctgggcctggagttcctaggggaggtcaaggaggtggtggtgggaagagggggtttaggatggtcagagcagtgaggctggcaagcacttggtggatctaggcagtggttatttaataactgatatggaggtgtttcaacattatagcaacagatgctgtcatgctgatgcacaccagctggttataggcccctgttttttcattagtttttaattttatgtgaagtgctaagaggtctcattttgcctgaatgaattcttttcctttgattttcacttgctactctcggatctcctctggtagcaataactttgaaaactgtgtaggttttcatttttggcttctgttgtttcaacagcggtgatcctattttctttaatttgcctttggctatatgccctgtcataaagaagaatgaaaagacagaaaatcaaatagaataaattttcctagtaactgctagtgcttgaggaacattactgttgattcatttattcaagtatttattcatgtattcatcaaatttctttgacctgctgtcgcacaaagggagtagtcctttcttcagaggtgtcaagaagaaagacacaggctgggtgtggtggctcatacctgtaatccgagcactttgggaggctgaggcgggcggatcacgaggtcaggagttcgagaccatactggctaacacggtgaaaccccgtctctactaaaactataaaaaaaattagccaggtatggtggcacgcacctgtaatcccagctactcaggaggctgaggcaggagaatcgcttgaacccgggaggcagaggttgcagtgagccaagatcgtgccactgcactccagcctggacaacagagcaagattccgtctcaaaaaaaaaacaaaaaaagacacaaaggtcctcctaagcccatacagtttcaggtctgcctctggctcaaagcaagggcagaatgagtcaactccagaacctatccattgatcctgaagacagatgagcactgtagaatctgtacactccgcaagtttaaacacaagcagtaaaaccacaacttgtcctccaaaataatttaaagctgatgattactggagggagggtaataatagatatttatagaacagcaaagaaaaaaatgtgattctcagttcaaaaggaatatagttacctttgatatggctatgcaatttatttctaagatcccaaaggcaattgtggtttgtttttgttttgttttgttctgcattgatttggctttgacagaactattgctttgagacgcagaaacaagtggtttaaactagaaggataaaggttctacagtccagtcctgactctctccttagctaactacgattagcaaatcttttccctgctttggatttttccttttgaaaaatggaaaagttgcagatgatttctaagattgttccattattctcaaattctttttttttttttttttttttttgagatggagtcttgctctgtccccccggctagagtgcagtggcgcgatcttggctcactgcaagctccgcctcccgggttcacgccattctcctgcctcagcctcccgagtagctgggactacaggctcccaccaccaggcccggctaattttttgtacttttagtagagatgaggtttcaccatgttagccaggatggtctcgatctcatgaccttgtgatccacctgcctcggcctcccaaagtgctgggattacaggcgtgaccaccgcacctggcctattctcaaattctttttgaaaaaaaaaaaagaagctatacataaacacactcagacaacagaattccttccagaactaacctccatgaagccctaattaaatgccatcaaacaaggctttccatagatatctggtaggcaatgttttcatgtgaaatattaataactctttagtgatgtacaataaaacacgttcatccaaaaaatttgattagtctttctattgtggaaaaacttatttaccttcaatgtatttatataaggggtcctaacattgtctttcattcattcattaaatatttactgagcatctactgtgtaccagaatctgttctggacactgaggctataccagtggacaaggtaaacaatgtccttgggtgcattctattaagggacaacgtagtcttatggcatttaggatgacctaatgaacaacacattgtaccacattttatacagtttatacacttttttcttgaactaaatgtctctgtatctgctacagtagaaatcccaagaatccagttcccactatggtcaaattccagtttggagatgattttaaactttagcagagattatatatctataacagactaaaagttttgtcaattgcattagggttaaaatgacattgtgtgggtcaaggagggaatttatcctagtcctccagtatgttaactagtaattaataaagatcctgaattatttatctgtttattgtgccccttccaccagaatctgttcaaggtggaaagtgtgaactgtatctgtgtggactggaaaggtggctcccgaactggatacacacaagcctcgcagaacatcaggatcgtgggagcagaagtggcatattttgttgaatttcttcaggtaattactcccggattgcataaaagcctgtacacatggttttccagattatctttccaaaaaaaaaaaaaaaagcctgtagatttaatcatagataaagacacttctctactcagatatgatgtttctcttggctacaaagaaaaattaaaaaaaatctagctttgggtttcatcaataacccattatgttaataaactagtttttttaagttaacttattcaagcaattggtaggttgtttttaataaattccacgagtatttgttttaattttactagttattaccaatgtcaaccttaagattaatctagttttatttgattttagttttgctttcttaagagaagcacggtgataacaagctaacctcatttggtaacaaaaaccacagaaaatgttatacttgaatgtgtttaaataattgtttttatttttactttctaatccaaatacttgcttcatcatctctggataacaactcttcatgttcattaagagttctctctccatagtaaaacaacaaaatacagccctacttccaccagattaaaagttaaacccatttccatttttcattataactattttaaaaaacatggaagtcaagtgctttggaaaggcagtgtatcttcttgacactgaggtttttgaaggttctccctctgcgcgcctcattgaattctgcaatacagtcatgcaccacacaaggacgtgtaggtcaatgatggacttcagatatgatggaggtcccataagatgacaatggagctaaaaaattcctattgccttgtgacctatagctatcatgataccacagcacaacatattactcatggatttgtggtcatgctggtataaacaaacctactgcactcccagttatataaaagtctaccacatataattatgtacagtatgtaatacatgataatgataataaatgatgacattactggtttacatatttactacactttttatcattattttaaagtatactccttcaacttattaaagaaaaataaaacagcctcaggcagatccttcaggaagtattccagaagaagacatgttatcataggagatgacagcttcatgcatgttattgcccctgaaaaccttccagggaacaagatgtggaagtggaagacagtgatattgatgatcctgaccctgtgtaggcctaggctaatgcaggtgtttgtgtcttagtttttaacaaaaaattttgacaagttaaaaaaattatcataaaaatggttatagaatcaagatataaagaagtaaaataatttgatacagggatacagagtgttttaagctaaaggttattacaaaaagttaaaagtttaaaaaaaataaaaattgtggcctggcacggtggctcacgcctgtaatcccagcactttgggaggccgaggcgggcggatcatgaggtcaggagatggagaccatcctggctaacacagtgaaaccctgtctctactaaaaatacagaaaattagctgggcgtggtggtgggcgcctgtagtcccagctactcgggaggctgaggcaggagaatggcgtgaacccgggaggtggagcttgcagtgagctgagatcgtgccactgcactccagcctgggcaacagagtgagactccatctcaaaaataaaataaaataaaataaaaattgcataaagaaagaaaaatattttaaatgaactgagtgtagagtaatgtacagtatataaagtcttcagcggtgtgcagtaatgtcctaggcctttacattgcttaccacttactccatgacttgcccagagcaacttccagtcctgcaagctccattcatggtaaatgccctctacagatctaccacttcagaatttttttattttttttcagacagagtcttgctctgtcgcccaggctagagcgcaatggcgcgatctcggctcactgcaacttccgtctcccgggttcaagtgattctcccaccttagcctcccaagtagtcaggattataggcacccaccaccacgcccaggtaatttttttacttttgtagagacggggtttcaccatattggccaggctggtcttgaactcctgacctcaggtggttagcccaccttggccccccaaagtgctgggattacaggtgtgcgccaccaaggccagcctaaaatcatttataccgtatttttgctgtatgtttttaggtttagatatatttggatacacaactagttacgttgtgttccagttgcctagagtacacagaacagtaacatgctgtacagatttgtagcctaggagcaacaggctgtaccacacagcccaggtaggtagtaggctatgccatctaggtttatgtaaatatactttatgatgttcccacaacaatgaaatcgcttgatgatgcatttcttgtaacgtatccctgttgttgagcaactcatgactgcacttgaaaacattctgaaaaggttttctttccgacagtcggcgttcggttactcaccttccaatgtgcatgtcattggccacagcctgggtgcccacgctgctggggaggctggaaggagaaccaatgggaccattggacgcatcacaggttggtgaaaacagtgaaagataccaggggggttgaggcaagatgatctcttgaggccagcagtttgaggccaatctgggcaacatagcgagactcctatctccttaaaaaaaaaaaaaagaaaaaaaggacgctacaaacttagactaaatgcagcctgtatgtgatttaaaaggaaatacaagatggaaatttggtgcaaccctacgttttaccttttcacattttctgaattgggccccatgatcagaaatcgctgttctgaggctttgtaaagtcttcattgataccaatctttggtctacagcactctgtttaacatatttatattgcacgtgactagaatatgaattaaggacatcgagagattttattcatgtctatttccccattgaccgacattcacaaaggacaagtttcatgaatagaataaatttcataaatagtagaataaatataattaaacctaaggagctgaaatttgtataactaattatattctgtttcattagcaattgctaatgtgcttaagcctcaaacataaccccagagttgtcagggaaaaggtggtcagggtgctctgggctgccagttctgtgtgctgctaatgagataacgaatagtattttacaaacctgaggctggctgcattcagccagtgagctcacatattggatacccaggttctaaaacctctgtaaggttataagaaagatgctaccatcctggatctgagaggtgattattttaaggaaggaccactttcctcttccatctgtgttcaacctttttgtctctgacttggtgattttctttttaacccttgggataagtcggctgtatttggacttgggataatctggactgcctatccgttcatttgctgaaggggagatctgcacaagattttcttttccacagtctgtaaatgtttctttcccacagcctgctcggccaggtgctgtgcagtgaatgcctgtggtctcagtgacgtttgtgaaagccaaggtccttgcccttgtgggagttcacagtctaatggggactattttaaccctgcgtggtttttagtccagtgtgtcccagagtctacctcttttgttgtaactgctgctagtgactaagactctcccagtgactatggagccatgaggaaaggcatattgtttggtttggggaaaattcactttaaagcaaatagctagaagtagattcctcttcagcaaatggtcaggtaaggaagaacccgttcatccctttccatgcataactcatattttactcttaatacttgtactcaggacttgtcataattcatgaaacatactctttactttagggttggacccagcagaaccttgctttcagggcacacctgaattagtccgattggaccccagcgatgccaaatttgtggatgtaattcacacggatggtgcccccatagtccccaatttgggtgagttcctcaacccgtcccccaaagggtgttatagtgtctgagtctatatacattagcataaaccctcatgtatttttatgatttcagggtttggaatgagccaagtcgtgggccacctagatttctttccaaatggaggagtggaaatgcctggatgtaaaaagaacattctctctcagattgtggacatagacggaatctgggaaggtagaactattatgtgtagaaagagatcttcttgggagaaagcttgtgttttgttttgctaaacttgctaaattctttggaattgtacaggtctcacattttacataacaaaagacttttaattgtatccatgagatgtaggttttcactgggataagtgggcatgaggagactgggaaagaaagcgtattttcagtcaacttcagagtacctaattcagggaatgagcttttatttatttaaaccaatctttttcttctacagtattttaaacctttcatttaattacagtattacctattataatcttaaacagtactcaacttgtgattacatcacaaatcataaatatactttacaaatgactttgttctgtgacctgcatgagctcacactaattagagaaatctattcaaccactatattctgaatatgacgttaacttggaaaaataaaatctgtccttgatgtgtaattgtgtctgattcaaagggactcgagactttgcggcctgtaatcacttaagaagctacaaatattacactgatagcatcgtcaaccctgatggctttgctggattcccctgtgcctcttacaacgtcttcactgcagtaagtagactccaccttccgcataaagaattttgtgactgtcacttctcatgactggtgtgctttcctatacatgacatcattcaatgaatgtttatacttttgaacttatacatgcctttaattatatgtatttaaatagtgataaattagagcactttagagaaatgagcttgtacatggaaatgtcctgtttactttcatttgtgttacttttgtatgcattgggtaaatgtccaaacttgttttagaaataaccctaaacagacaaaaaataattagtctatggaaatctgagcaatatctgtaggatgctgatgaacatggaaaaattttcttaaatgctgacctttctaactattaatatataattatagacatgtggacatttctgtgcaatttcataatggccaaaatttttttttgaattttcatcttatttggtattctcttgatatcttggttgaattatttatttaattttactttaagttccaggatactagtgcagaacgtgcaggtttgttacataggtaaatgtgtgctgtagtggcttcctcttggttgaattctttatatgtgatctcaaatatgacatatctattgtctgggtttttttttttataaaattgactttgctttgtaccataaatttttgaaataaaaatttaaaacctatggatttaataagaaaatttccagtaacaaatgtgccagctgaagtcacaattacccaggatatataccttagtgattaagagagaggatgcaaatcttggtttcaccattaaatagctgaatatctttgggcaaaacagttctccaagaagtttcttcatgtataaatgtaaatactgatggcaaacttaacatatttggtgagaggacttaatgagaatacatacgttaattgcttagcccagagcaaaaaaatataatagcattcaattaatgttagctattatgggagagggagtacatatattattcacactacagcttccatatgcagtgagacagaagatcccttctttatttattttaactttatttttattttcttccccaatacccaacaataagtaatgggggaaaaaaataaagaagcaaacacaaaagcctcaggtttcattcagttaaaacttagtctaattcaacaatataaacagttctttcaagtgatactcatcacttgtataagaaaaaatgtctcagtcttgcagatttcttcacctttgcactcccttctaagcttctctccaagtgagtgctggggccaggtgatctggtggtggtggtcgatgtgtgttcagcagaggaaatgaattgggagtccatgggtgtaaagtttttgggctcctttcgactctgggtaatagccttgcctgttttattgatgggcacactgctgtatttagagatgacgtcttgggcttgtctattcttctggctctagcaatgccctcagagagctttggccatttcttcccggctggcttaggcaacacctggattttgttgaatgccaaccctgggactgtgataagcccataatatggtccattgagccaggagtccaccacttgccttcactgtagagtagccctgcccctcacagtgggaattgggacacttgtcctgccaacttggttcctccctctccatctctttttcccagaagtccttggtccagaaataaggggtattttcctatacgaatatgtcttctccaggtatcagcctcacagtaagccttaggctagctggggcattttctcttcacatagagaaaattccgggatctgaatccttcagggcttgatatgctaaacatgagctaaaacaattgaaaaaagccgggcgcggtggctcatgcctgtaatcccagcactttgggaggccgaggcaggtggatcaggaagtcaagatcgagaccatcctggctaacatttttaaacctttaaaaaaaaaaaagaattgaaaaaagcctgacttttgagcctattgtcctcctaataaattctattttgtttatcagaagctgattataatctctgttctacttatgcaatctttctttcttttttttttttttttgagacggagtctcgctctgtcacccaggctggagtgcagtggcgctgtcttggctcactgcaagctccacctcttgggttcacaccatcctgcctcagcctcccaagtagctgggactacaggcgcccgccaccatgcccggctaattttttgtatttttagtagagacggggtttcaccatgttagccaggatggtcttgatctcctgacctcgtgatcctccagccttggcctcccaaagtgctgggattacaggtgtgagccaccatgcacagccaacttatgcaatctttctaaaataaattctagctgtaagtagatgaatgtcttgggagcaaattaggcaaaagagaaaaaatagaagatagatacacacacacacacacacacacatattctctcattgtatgatttgttttttttttgagatggagtcttgctctcttgcccaaggcttaagtgcaatagtgcagcctcggctcactgcaacctctgcctcctggattcaagcgattctcctgcctcagcctccagagtagctaggattacaggcgcctgccaccatgctcaactaatttttgcatttttagtagagacggggtttcaccatgttggtcaggctggtctcgaactcctgacctctggtgatccacctgcctcagcctcccaaagtgctgggattacaagcgtgagccaccacgcccggctcgttgtagatttttatagtattgtgttgtttgacagtgaagttggtgacttactgttgtgaataatgaaatgcattgttaatctttgctgctgagacactattaaagtccccatttatcatcagaacagaactggctttagaatatttgaatggcgacaacatgtaggaaatatggtacacaactaaaagatagggcatcctcattcatcatttgtttgttttcactagaacaagtgtttcccttgtccaagtggaggctgcccacagatgggtcactatgctgatagatatcctgggaaaacaaatgatgtgggccagaaattttatctagacactggtgatgccagtaattttgcacgtaagtttctgttttctgtatcttatattcttattgctatatattttattattatgtccactgaaaatgtgcatacttgcttttctatacaaaagctttaaacaccccctctgcaaggtggaaaaatgctcaatgctatgttcaaggtaattatagctaattagggtggcagaacggagtttgggtcctggactcttaatgctgcaaaaataagtttcttcatatttgattctggtgctgaattcagaaggctttctctgctccagcctctttatattcagtcaaaagtttcactgaacaaaattctgagatttttgtaaaagcagaaaagtaatctaggagagagagatggcagaggttgtgagaatggaaagacattgacagatttaagagacgtttaggattgtaggctccatgggtgatgggaattagaggctggaggagtggtaggaatgggaacaggttctgggtttcttttccaaataacagaggaataaaattatttggatgagagttaatggggttaccgacatttttaaatactaatgacaaattttatctcctccccaatttgctctgcctatctctaaatggcaaactattggctagcaccaagaaaacgttcttttggttttcataaattaatatattcccaaaggcaatgaaaagttgaattatagaattttgaaaataaatgtagatatttagacaaaaagatagcagtaccctaaaatttggtgatctatgaaaataaattaaactgaaaaaatgtcacagttcacaattttacaactaccttttaacataaagttcttataactttcaaggataaattgtcaggttggaaattgaaaactaaatgtattccttagtcccttggcttgaaaaaaaatctgtcttaactttgaaaaaattctgcaaagcccctattacctaatgcctgtcccctaaacacatataaaggaatatctatcactatttcattagaaaattacacacacacacacacacacacacacacacacaattataaataaattattcaaaacgtggcagtagtgggatgcaaattaacttgtttttagtgtcttttatctccaaactgacattttgcaatttttctcccttgcaggttggaggtataaggtatctgtcacactgtctggaaaaaaggttacaggacacatactagtttctttgttcggaaataaaggaaactctaagcagtatgaaattttcaagtgagtaaaataatattgctctatgcttttttttttttttttttttgagtcggagtctcgctgtgtcgccggggctggagtcttgctctgtcacccaggctggagtgtagtggtgcaatcttggctcactacaacctctgcctctagggttcaagcaattctcctgccttagcctcccgagtagctgggattacaggcgcccaccaccacgcctggctaatttttgtatttttaattgagatggggtttcaccatgttggccaggctggtctcaaactcctgacctcaggtgacctacccacctaggcctcccaaagtgctgggattacaggcatgagccatggtggccagccaatgcttcttaatgttggaatactgcacatgtataatgtatgtcatcgacataagagtttgtctattcattactaaatggaagtagagtactgacatgtataagggaaaaggaagcaattatgtcatccttacgccttagtaccattcagaattcagtttctaaatattttcatgctatttcctgataaaaccattcatgtttgctttgataactggcatctgatttatgatcagtaattaattagtctgcccacaaaacacatgtgaaaagatgatggcatactctcatcatttattaaattgtgggggaatggtgactaatacatgtttgaagttttactaaagtaaaggtgactaatatgagatgttcatggcaaatggactaccactgagttagcatgcatgtctgaatttgtttaatatgttagaatgcaaatgtactgccaatcaccttagccagaaatgcattgtaagctggtcttagaaacataaatgtgtatgtatatatgtacacacttacatacacacaaatatatatgtatatatttacatgtatgctcatgtatgtttttgttaacttcttaaatccttaggggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagtaagtaatgaaaatcccaggagatgtgaaatatcgagtctgtgtttatagttctattcccactaaaagtctaatttaagtgaaacctcctacaggggatcgcctacatcctagttgcagttgcttcctaatgccttctgtttctttagggaaaagggtagaactttaggaaacagctttgatcaattcatgatagatgtgtgttagctgatacaaattaaatgttagaatgagaaaccggcttcatgattctaaggtgagaggaatgtttcctttggcagctgtgcttcgtgctatgtgagtgcttcttgtgtgcatcttccaaacttcccaggctcacctaattgctgtttaagttgctggaaacacagtgaatgtttcaaggaatagaaataggcttttccaaatcactggtcttcttagtgaagacgaaggtccaggagataattcttggtttcaaccaggactggagtgtgtgggagccaaaggatggtgaactaccaggaaaggtgatctggtgataatcataacaataccaatactagaccaagtatttctgagtattaggccaaattctgaggcaagcactgtgcttctgtcattctatccttccatcctcataaaaaccaaatgagaagactttgcttctggcaaagatggagtaacagagcccagatttactggcctgactgaaataaccaaaattcaaacaaagtacatgaaaacacagttttccagacactgaacattgaggaataagggatagtgattgctgagagacaaaaacggacaagatggagcctggcagttgccccagcttactgctccgagagatttccaggatgtgtcacagggaggagaaacccaggcagagttcagtggactccttaagttaaagaatcagagctaagaatgagaagatccagggaagtagatttcacaggacagcataccagagaggagagagttgctgagggagaatcccagagattatgaaaagtctccctgaatattcatcaaggtactgattgacccatgtatgagaacaaaccagctggaggtcattgaaatatccatttgatggattagagaaaatagttcccctacttttgcaggactgagaatggtgcttgtttccaccaagcagtctggaaaagtttataattcaaaggacacagggtagagtattttagaaggtcttgctttatagtggaaaataatttacctatattgaccaagatctgtaaagaaactgtttccaaataactgcattgcagaacaaaaaggtcaagaatatttataaagatccagaattatcaagtacctaaaactctaaaatccacagtatctgactttgactcaaagattcccaggtatataaagaagcagaaaaatacagcctataatgaggagaataatcaatcgacaccaaaacaaaactgacatagatgttacattagcagaggagaaaattaaaacagttcttaaacctgtatccatttgcttaaaaggtcagtaaaggcatggcatatacaggttaagtgtttctcatccaaaatgcttgagatccgaagtgattcagattttgaatttctttagactttaggaatagttccattatatgtaccagttgagcatcaaaaattaaaaaaaaatccaaaatctgaaatgttccaataagcatttcctttgagcatcatgttggcaatcaaaagtttcaaatttcagagcattttggattttttatttatttttaatatattttatttttccataagttattggggtacaggtggtatttggttacatgagtaagttctttagtgatgatttgtgagatcctggtgcacccatcacctgagcagtatacactgcaccatatatgttgtcttttatccctcgcccctcccactcttctccccaagtccccaaagtcctttgtatcattcttatgcctttgcgtcatcatagcttagctcccacataacagtgagaacatacgatgtttggttttccatttctgagtcaagtaactcaggaatggatttttttatttttggatttaggatgctcaacctatatagaaaaagacccacactgagtttctagagatgaaaaatacaatgtcacaaacaaaaaatgcacagaatgtaattaacagtagattagacattatagaagacaaggttaatgaccttgaatacataatagaaactttctgaaatgaaatacacagagaaaaaaatcttaaaaataactttaaaagaacatcagtgatctgtgggacaataataataaggcttatttatttgaaataagacccttttttaggtctttgaagaccctaacaaagaagggacagaaaaatatatgtgaagaaataataccttgaaaattttcaaacatggtgaaaactataaaccaacagatcaaagaaaatcacaagaaacatgaagaaaacagcacagcaccaatacacataaaaatcaaaatgctcaaaccaggtagaatgtacattattcaggtgattacactaaaaacctagattttaccactatacaatatatccatctaataaaacttcacttgttcccttaaacttacacaaataaaaaaatgttgaaacccaattataaagacaaaatattgaaagcagtcagagaaaaaccacacattagaagagtaaagaaaaaaataacagcaaatttctaatcaggaacaatgcaagccagaaggcagtgaaacaacatcttagagtatggaaaggaaaaactgttaacctggaatttatacccataaatatctttcaaagacaaagatgaaataaagacttttaaaactgaaataattcctcaccagcaggttaacactaaaagaaatgtcaaaggaaggccttcaggcagaggaaaatgataccaggtagaaaagaattcactaaaagaaattaagaacacaggaaataggaaatacatgataaatacataatatttttaattcttattactaaattctctttgaaaaaattgactatttaaaaaataatgacagtattttggggagtaaataatatatgtataagtaaaatataacaatgacataaaaggcaggaggggagacctgaaaatatactattggaaggttcttataccatttatgaattggtatactttcccttgaaggtgtgataagttaaaaatatgcgctataaattctaaaataatgaaacaaataatgaaacaaccactaaagtaatgaaacaaaggataatagcaagtaaaccaaacaaggagataaaatggaataaaatataatccaaaatagagtataaaaagagctaaaaggggccgggtgtggtggctcacacctgtaatcccagcactttgggaggccgaggcgggtggatcatgaggtcagatcgagaccatcatggctaacacggtgaaaccccgtctctactaaatacacgacgcaggcgtggtggtgggctcctgtagtcccagctactcaggaggctgaggcaggagaatggcgtgaacccgggaggcggagcttgcagtgagccaagatcgcaccactgcactccagcctgggtgacagagcgagacaatgtctcaaaaaaaaaaaaaaaaaaaaaagagctaaaagagaacaaagaatataggagacaaatggaaaacaaatagaagacaatagactcatatctagccatgtaaataatcatataaagtaaaaatggtctaaatactacaattagaagacaaaacttaccccactgtattttttaaaactcaatatccaattgtattctggctatataaaatgcactttttttttttttttttgagatggagtcttgctctgtcacccaggctggagtgcagtggcacgatctcagttcactgcaacctctgcctcctgggttcaagtgattctcctgcctcagccgcctgtgtagctgagattacaggcagcagcaccactcccagctaatttttgtatttttagtataagtgggatttcaccatgttggtcaggctagtctcaaactgacctcaagtgattcacccacctcgaccttccaatacatctcgctgagtcagcgattttggtgttcgatatttacccatgaggcaagaacacatatgattatacaaaagatttgtacatgaatatttatagcaatttttttttgagacagagtcttgctctgtcacccaggctagagtgcagtggcacgatcttggctcactgaacctccatctcctgggttcaagcgattctcctgcctcggcctccccagtagctgggattacaggcatacgccaccctgcccagctaatttttgtatttttagttgagactggttttcgtcatgttggccaggctggtctcgaacccctgaccacaggtgatccacctgccttggcctcccaaagtgctgggattacatgtgtgggccaccgtgcctggcctgtagcagcttttattgtaacagccaagaagtagaaataatccaaatgtctaccaatagaggaatggataaacaaactatggtctatggtctgtccatacaatggaatattactcagcagtaacaaggaatgaactaatggtacactcaacaatatggatgaatctcgagataattatactgaatgaaaagctagacaagagtgcacacaccttagattccatttatataaaattccagacaattcaaactactctatagtgacagcagagccgtggttgcctgggaggagtgaatattggagggaatgggaagaagcaattacaaagaggaagaaagaaaattgggggatgatagatatgttaataactttgatgttggtgatggcttcagaggtgtgtgtgtgttgtgtgtgtgtgaaaacgtatcaatttaaatatgtacagtttattccaggtaaattaaagctcaataaagctgttaaaacaaaaatatatatcctatgaggtagatggttttattatccttattttatggataattaattaaggtactgtttctgaatttctatgcaggaagtttgactctacaaaattcttaactactacaaaaaaattcagttcacctttaatcatgtataaatattggtgcctttcttttcttgtgtccctgattgataacagttttaacctttaatttcctatttgtgaggctgccagtcattgaggaagtgagcgtgaagggaaaaaaacattttctgagcactttttttctgttcctggtagtttacatatggtaaggtattttattaaagaaaaatattccaaagcatcctaagtattgttcagcctgttctttctttctttccttttttccctccctcccttcctttcttccttccttccttcttcccttcctccctccctctgtcctttccttccttcctttcttctttccttccctccctcccttctttcttttcattccttccatccttcctccctcctttctttctctttctttctttctttcttttcttctctttctttcttttctttctttctctttctttcttttctttctttccttctttctttttttctctttctctctttctttcttctttctttattccttccttccttccttcctttcctttatttgatccacacagggaaagaaggcatattgttcagtcacaatgagaaaagtttgtcatttcagttcaaatattgaattaaaataatggttagccaacgtaacaccagaaattagactttatacactgggctgatttcttatgatggtgactctgctgttcctgagttgcattggttgacatgggctaagtgttcagtgactgctcatgacaaatgagtctttctttttctttggggcgtctactgacagcttctctctcagctattgcacaaccagaaaataacactggaaaggagaattcagtcctttatgtagaagaggtcttccctcagccattgtctggtctccagcacagggtgcgcccttccctcagactaggaggttgggggcatagattgtcctcactgtcacactccagatatgtgccaggaagaggaggtgactttgtgttgttttttctccacaggttcaacttctgtagtccagaaaccgtcagggaggaagttctgctcaccctcacaccgtgttaggagactactgttatttgaccaatgaattgacttctaataaaatctagtggtgatgca

SEQ ID NO: 19 - DNA, 7967 bp, Artificial Sequence
  Based on Homo sapiens sequence
agtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggtaagggcctaacgggaactcggaactcggagctcggagaggcagccctcaggtcggggtgaattgggggcggggagggcggccagccttaagaagactggaacctcgaggcctgttcgcggggcggcgggtaaaaccctgttgtcgccgaggtggagaggccccaggtcccctccgtagagcgctggtctcaggtccctgaggaaggagagcgaggcctgggtgcgccggcatgctttcttggcctgtgagaagacccggactgctgattcccgctctcggccctgcaggcccggaactgcagcacaaagccccttcccgctccggcggacacccggcccgttgctggccccgagaccctgccgggacgcaacaagccgccttaccccagcttcctgtccacgtgcagcctcctcggggatggcgggatggggacctgatccaggcttgttaatgtgtgggggcatcgaggtgaatataatttctgtgacacaggtcctggagaaacgaggaagttaaatgaaatagtacttcctgtcctgtttcagacatttagatttatttgaaactatctttttggaacttttgtgattttttctccttatgatccacatctctgaaagtatttgggtgcgactgtgtgtgtctacatatgattttgcactgatttgtaaatcttttacaggcccatccaagccagattgctggccctttctggtcctggtggaggtagaggacgtggtagtttattactgaggtaagatttcctttggactttactcatgctgaaactactggtactttactaaatatgttggtttgaacaaaacctgtgataaaatcaataacccagtgtttgtcgtctttgttttgtttaatgttgtaatagactagatttctgtataaatatagttatcctgaaaaactggaggttgaagaatatattaagtttaccaattttgagtgaacttaattcttataaagtaacactataaaagcattttggaatgaatgcccgtttaaggctactttagttggaaagatttttgaaagtttaaccatattctcttgtcaaatggaaataccatttatcttgtatttcaagtgttttatgttgaacattttaaatttcaggcgtggattctcagatagtggaggaggacccccagccaaacagagagaccttgaaggggcagtcagtaggtaggtttaaaaaaagattcctgaaggcttctttagtttctgaggtaccacacaaatataaatgtttattaacaataattctgtttcagcaatattaaaattgagtggtatgccactccctgccccccccaagttctgttggtatttgactgaacagttgactatcagttccctcaaaacgcagttctgcactcatgataacctaaattttatccaaataaaggtcatgtgaagagtaaaattggaaaaattgtcaattagtaccattttttctgacttgtacttgaaaaacttaaccagtttgaaatacttagaaaatacaggagagcaaaattggtttgggcgttagttcacacattgtagtatcctttctctgctggaggaaagaataaaatgggatggagacttgatagaacaaagcttctggaaacgagtcctagaagagagggcatttgcccttggtgtgcagttacataaatacctcagtggtcatttaaattaatttttggccaggcacagtggctcatccctgtaatcccagcactttgggaagccaagaccagcagatcacttgagcccaggagttggagaacagcctagatacatggtgaaatcccatccctacaaaaagtacaaaaaagttacccaggcatgctggctcacgcctgtagtcccagctgcttgggaggatgaggcaggaggatcacttgagcctgggaggtcgaggctgcagtgaaccgtggtggcaccactgcacttcagcctgggtggtatagtgaaaccctgtctcaaaaaaattaatattttctatgacaggctgggcggggagcgtcggaccagaagagaatcacgccaggaaagcgacccggaggatgatgatgttaaaaaggtattgagattgaaagaacttaaatgaatgtagtaccttcactttactacatttaaaagcacaccactcatatgctagttaaattactgagattttctttttctgcagccagcattgcagtcttcagttgtagctacctccaaagagcgcacacgtagagaccttatccaggatcaaaatatggatgaaaagggaaagcaaaggtatttccctgggggaaaaaaactctagtgaaataatgcagttataaggaaaatcaagggattgttcaagcatcctgtagtatttcttagaaaatgatgggtttaaatgaaatggatcctgttgacagtaaattttcttattctgttctttaggaaccggcgaatatttggcttgttgatgggtacccttcaaaaatttaaacaagaatccactgttgctactgaaagggtatttatccaagttttgttttgcatcatatatttaagttatcaaagtagtagattaatgttttttttaaaaaatccttaaagctcttttaagacctaactgtaaacctgaaacaaagccaagtaaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgaagcggccaggtgcagtggctcatgcctgtaatcccagcactttgggaggctgaggcaggtggatcacctgaggtcagaagtttttcgagaccagcctggccaacatggtgaaaccctgtctttactaaaaatacaaaattagccgcctgtggtggcatgcgcctgtaatccccagctatttgggaggcggaggcaagagaatcacttgaaccctggaggtgaggttgcaatgagccaagatcacactattgtaccccagcctgggcaacaggcgcaaaactccatctcaaaaaaagaaaaaatgtgaagcatatgcagataccttttttttttctttttctttttttttgtagagatggggttttatcatgttgcccaggctggtctgagctcaaagcaatccacccacctcagcctcccagagtgctgggatgacaggtgtgagccactgtgcccggcctgcagatacctttacatagtgaaaaaaaaaaaaaaaaaaaaaattttttttgagatggagtttggctcttcttgctcaggctggagtgtagtggcgtgatctcagctcactgcaacctccgcctctggggttcaagtgatttctcctgcttcggcctcccaagtagctgggattataggtgcgtgcaaccacgccctgttaatttttttgtgtttttagtagagatggtggtgttggcttctgacttcagatgatctacctgcctctaatgtttcacgtaattagtatgtgtaataactttttatcataattgaactgaaatcatatataccttttgttgtaactatttcaacacgtaagtattaaagcaggctacttaacttttagcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctggtgagtggtaatttggaattctaagattggtaatcctttgtgtttacaaaagcactgaccctttaccttttctttagcaagaagaatggaatgaacataatgccaaaataattaaatatataagaactaagacaaagccccatttgttttatattcctggaagaatgtgtccagctacccaaaaactaatagaagagtcacagagaaaaatgaacggtaagtatgcgaagaggtccattgaattgttcatagtgggtaaggtaatatgttcatatgcacacgtttgttttctaaaataattatgattcagtgattggtttgctgtgtttgctttttttttttaaataagataataagatattctaggccgggcgtggtggctcacgcctgtaatcccagcactttgggaggctgaggcaggcagatcatgaggtcaggagatcgagaccatcccggctaacatggtgaaaccccgtctctagtctctactaaaaatacaaaaaaaattagctgggcatggtggtgggcacctgtaattccagctacttggcaggctgaggcaggagaatcacttgaacctgggaggcagaagttgcagtgagccgagattacgccactgaactccagcctgggcaacagagctagactccatctcaaaaaaaaaaaaaaagatacattctgagatgctggtgagtttgtagtataggaatatttgtatcatgatggagtttaatgtgaaagttatagacagtgcttatgcatctgtattccttaagcatttgtgtaaaattacttttttttgcatgctattattgttctgataaaatgctaataagacaaatgtgaaaaccaactcagtttctagatggaaaacacatggaaggatagacactgctaagatgatgatttatctctttgggatcagaaaaattaatatatatgattttatgccaaaactggttctgttttacagaagttttatttttcatcagacataaagattgatctgttttcttcatcagttagaaaatgtgtagttctgtctgccacaatttctagtatgtagatttcccatggatctttgcttttataattttatgtcagtttgtggttacttaattgccataatcttttgtcataactttacaaaaacaaattcagatgaagcttaatgacaatttgtgaccagttataaaattatggctttgaattttcttaatcggtaaattttacacatgtaaatttttattctttagctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgcata

SEQ ID NO: 20 - DNA, 2922 bp, Artificial Sequence
  Based on Homo sapiens sequence
agaagccaactcagactcagccaacaggtaagtgggcattacaggagaagggcgtctctaacatgcactgtagatctaaaatcttcgggaagatacagcatgagtttctgtccaagaggttttagctgtaatgaagcctcagtgggatccaaagttgtttttcagttactgagtctgtataatccccactctcaagagaaacatttgaaggtgtgggtgtctcagaggaccttcctggtctcagaaattctgagaggaggttttaaggaaggtaataggtgctttgctctccatctctcagaacccccttctctgtgttctcctatagagattgttgatttgcctcttaagcaagagattcattgcagctcagcatggctcagaccagctcatacttcatgctgatctcctgcctgatgtttctgtctcagagccaaggtaagatctcttttccaccaaccaactctttctagccctgaagacttcactctatccccaagcatacgggtctacttgaaaaaaaaaaaaaaagcagagtcactgttaagggttgttttgtggtgtttagtgatctttattgctgatctcttcacatttatatacatccacacctcattaaggagttggagctagaatttaaaatgaccccttataagcaactgctgcagttggcatgagtttatctgattaaatttatacgtgatggtggatttggggatgtctgtgtgtagacagtcactaatggggtggagaactgaagagagccttgtgttcagggaaaccaagtcaggcttgagaaagtagaaggctgagtccttcaaggtagaagagcctgagctccagacataaaagggaaactggagacttgtttctttggcctattcattctgttttttttcccctgatcaaagaaaccaaagacagaagatgtaggatgcaggagcaatagtgagcagtcatcccataatagactggattcttctgtttctataaaggaacctcagaagctcttacctcaccttcaagccttttccttaccctgagagcctcctttaattgtctcttctttttcaggccaagaggcccagacagagttgccccaggcccggatcagctgcccagaaggcaccaatgcctatcgctcctactgctactactttaatgaagaccgtgagacctgggttgatgcagatgtgagtgaggagagcagtgtgggaagggagactcatgaagggaggggaagctgccactctccagtgtgttcagtggctgcaatgagatgagactgaaccccttgctatactatcatcagccccaaactttccaatctactttatcccattattcagcacattcccagcacaaagaacctggtggtcagtgacagcatcatcacggacattactctgctgtcctttttctgacccgtcctcttggaggactcagtatatccgtcacaacttcctcctccactgagtgctccattttcttctgcaacagctctattgccagaacatgaattcgggcaacctggtgtctgtgctcacccaggccgagggtgcctttgtggcctcactgattaaggagagtggcactgatgacttcaatgtctggattggcctccatgaccccaaaaaggtaggctgcagccttctttatctcctaatgatcaggtttgagaagtaagaaggaggttcaagttctggtctcttaagtaccagcttttatcgctttccagaaatcaggctgtttacagatcctctaatgtcctgtgtagcaaggtgcactgtagatgattggagatataagtggaaggctgaatttcctaggtgttcttgtcattcatgaataaacttattctgttttcagtcaacaaagcatctttatgcaccaacttcttacctattttgttactgtcagagtcacaagagagactagattgccgactatataggaaaggagacttgtggtaaaaatctgctgctgtactgctggcatttgggaacctggtagtatactaaataatataatatatcaacaactaatggtcagccaatgctatgctggatatgagggtcctgggccacaaagacaaaaaatcaggaaccactttttaagtgagatactttgggtctctgtcaaattcataacacttatttcttggtggaatacagttaatgagttggacagttcaggaaagaagtttagagcaatagcaaaggaaaggaaacaatatttagcaaggtttattcttcctttgtgtcttagcatgtttctgagtgtgcacacaggcccagtgattccatgtatttttgagtgaccactgcctctgttctggcccttccccatctagaaccgccgctggcactggagcagtgggtccctggtctcctacaagtcctggggcattggagccccaagcagtgttaatcctggctactgtgtgagcctgacctcaagcacaggtgagaggcagagaatccatccacctgtttctgttctctcctgcttagctccagggatggaactgggactgggatagaggaaaggtgaactcctcattaaggaaatggatgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcaactggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccacta

SEQ ID NO: 21 - DNA, 2971 bp, Artificial Sequence
  Based on Homo sapiens sequence
aagccacctcaagtggacaaggcacttaccaacaggtaaaggggcattacaggagaagagcatgtctaacgtgggattttctcttttcattttgaggtagatacagggtgattttctgaataaaagatcccagtagtaatgaaacttaagcaagaccaaagctgatttcgggtaatttggcctctgttatccccaaaccaaaagagaaatatctgggagtgtagctatctcagtggacctttcggctcacaggaattcagagaggagaggatgttagaaagataacaggtgctctgctctcttcttcaaaccctcttccctgtgttctcctacagagattgctgatttgctccttaagcaagagattcactgccgctaagcatggctcagaccaactcgttcttcatgctgatctcctccctgatgttcctgtctctgagccaaggtgagattttcccccacacttcccacaaccccaactctgaattcttccctccatcctcatgtataaggttcacttgaaaaaaagcagagtcaacatcagggtttttttatgttgttcagtgatcattatggctgattttatcccattcaaaaacaccctcacctcattcatgggtttgagacagaatttaataggaccacttataggtgaccattgtggttgagtttatctgattgaatctatatgcgatggcagtttgggggatgtttttatgtagtcattgctaggatggagagctaaggcaaacgtgtgcagggaaaccgagagaaacttgagaaaggaggaagcctgggtctttaaaggcagaagcctcagcctcagaattaaaggaaaacgaggactcatttatttagcctattcattgtgagctcttgtcttgagcagaggaaactagagagaaaagagataggatgcaggagggcagaagtgagcaatcgccccagtattcactgtatccatatgttcttataaaggacaccaagaagcccctaattcaccttccagccttttccttgccctgcgattctttcttaattatctccttttttttttccccaggccaggagtcccagacagagctgcctaatccccgaatcagctgcccagaaggcaccaatgcctatcgctcctactgctactactttaatgaagaccctgagacctgggttgatgcagatgtgagtgaggagagcagcaggggaagggaggcttatgaaggtagaggcagctgctaatttgcagtgtgttctgtggctgcaatgagataagattgatcccttccctattccaccactggtcccaaacttcccaatctactttatcccatcatttgacacattcccagcacagagatgctggtggtcagtgacagcatcatcagggacatttctgtgctgtcctttttctgttacatcctctggaaggtctcagtatatccctcacaccttccttctccactgagtgctccattttcttctccaacagctctattgccagaacatgaattcaggcaacctggtgtctgtgctcacccaggcggagggtgccttcgtggcctcactgattaaggagagtagcactgatgacagcaatgtctggattggcctccatgacccaaaaaaggtcagtctgcagccacctctatctccttataaacatttttgagaggtaagagggacgtttaaggtctggcaccgcaatcaccaacttttatctttttgtttgtttaaataaaagcaacctctttatagatcctataatgtatgagttgtgaagttcagtgtaggtagttagagacatgagctgaaggctgaattttctgggctctgggaattcatgcacccactcattgtgtctacttctagaaatgcatctttatgtacaactttttccctattttgctattgtctgtcttggaagaggtccctctgtagactatatagaaaatgagtagtggaggagaatctactgctggcatttgttatacattttatacaagtgtataaaactgtacagtatattatttagtttaacactataaactaaataatatatcaacgactactctacagccaatgttatgctggatatgagagttctgagattcaggaaaaaaatcagaaaccactctctttaatgggcttttatgggtctctgtatcaaattctgaacacttattatttgctggaagaggaggaggaattcggacattctagagaaggagaagcttagagcaaaagcagaggaaatgatatgatattcatggtgacaacaatgtttattctttctgctataacttggcctgtttctgagtgtgcacacaggcctggttattctattgatttttgagtgaccatggcccctgttctggcccttctccatctagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggtaagctccttatctggaaaataaagaagtatttcctctagttttttgttctgagtcctaggttgaggaggggctacactccttctgatcctctatgtctgacacttctcattgtaccataggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttatttttatccagtg

SEQ ID NO: 22 - DNA, 14239 bp, Artificial Sequence
  Based on Homo sapiens sequence
ggcgacgcgcacgcgcgccagcccggctcgcgccctctcgctttcctccagccgcgagaccccctccccttccgcctcgcggcgcttcctcgcgccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggtgagaagggtgggctccgggcgagggagccgcggccacccagaggctgtggctcggttccggtggggcggaccccgacccggcaccgtcaggggcaccggctgggtggggagtccccgtgaagctgggggagggccccctcaggtccgaacaggtcggacggaaagggtccccgggcggccaccggagcactgaggggccgcgctcggctctcggggcctagtcagggctcgcagccccggccttcaggggaggcggggcgcatcccgccggcgccgtcggaacggggagttgggggggggcaaggagctgatcggggtccccggttccattaccacgaagggtctcgcggtccccggcttcagccaatggggagtctgctgcgggaaggggtccccggccgtagccaatggaggggggcgcgcggcccacagtttggccaatggggagggagggacttgggagcgggttgctgcctcccccttcccggtctggccagtaggaggggagcgaggtgggcggggggacggaaggagggatgactgggaggactgcgggccgggagcctctggcgcgcgcgcccccttcccgtacgtgcgcgtggatgctcggtctcatgacccgggcattcgcgcgccccgggaacacctagggcagggactagttcgtggaggggctcgtctggtggcagtgcatgagtagtggaggccctgctcagtttttcctgtgcgagtgtgtgtgtgttaatggaattaagagtggcagcacacgcaggcgcagtgggctctgatcgctggaggtgggggttcggaaagtcccgtgggttttagtgcgcaggcgcagaccgggcgaggcctcccggtggatggcttttgcggctgcgctgtcccccagccccgccagcggccccctcttcgccctcaaccgccggttacatcagccagcgacgagcagggttacctggcgattggtgatccccgcagagtgggtaacgggctgaatgagtcatgaggtcgaggggatggggtgtggaggggatacccctcctcccacagttttgaggcgtcaggctgctgaaaatgattgtcttttctgtttgggaggtaatgtacctgagctaggtagttccaaagctgcactcctggagcttttgccctcacagctggcgtggctttttggttaatactgtagcattgatctgttggtagcctgcagccctagcccctttctcgttggttcttagagcaattgacaaccattgttgattgagatctttttgctggcatttggaggaaatgtgtttgctggcttattaatgtctatttttttcttcctctacaaggtgacagtttgaaaatcttatttattggccgggcgcagtggctcacgcctgtaatgccagcactttaggaggcaaaggtgggaggatcccttgagcccaaggagatcgataccagcctgggcaacacagatgggaaatcccatctctactaaaaattaaaaaaaaaaaaagccaggagtggtggttcgtacctatagtctcagccactcgggaggctgaggcaggaagatcacttgagccttggaggttgaggctacagtgaactgagatcacgccactgcaccccagcctgggcaacagagggagaccctgtctcaaaaaaaatagaaaaatcttactgattaacaattttgtagtctaaatcagcatcatcaggtggtatatacttctaggatttaacattaatttcatagtggtctaagagggcttgaacagacttaagtaatttcttgttttcttttataggggacagagcacaggaaagggacccccacagtcacctgtgagtgtcttctcccaccctgtttaagatacatagacctaaaagatgcataatgtgggaatatagggcacattaggtctagatagagtctaatgtactcaggagggctgtgggcccggcacacacaaggcagaatgagtagagtgcggcgggcatttagaaaagaaaatgaggtgttgactgattactcctttaattctccctcttatgttaactgacaggtgtttgaaggcgtctacaacaattccagaatgctgcatttccttacagctgttgtggtaagttggtacttaacccccgggttgtttaaggaacgtaatgcatctactttctggagacactcttcttatttttcccactctgccagggctccacttgtgatgtaaaggtgaaaaatggtaccacttatgagggtatcttcaagacgctaagctcaaaggtcagtgtactcaaatttaattatttttggagttgcagagtaggaggagaatgaaataggctcattgaaggtgtcaattgggtgatgtcagagtatgcctttagttgtttctgtaggcctgtgctgaatagtgctgcagggaaaaaagacaaatttgagggctgggtactttaatgttaaaatatttaagtttaaatttttgtgagacttttgctaagtcctgtggctgatgttgagaaaacaatgcacttggttccaagcatgttgaggatgtagtgttgtgaaaagtttgggaagggtaagagaaatccagttctatttaagagaaatccagttctatttttgccttcacttttcttgaaactgacccatgggtgtggggaatggggtgtttgtagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaaggtattgtcctaggctgttacctcagacctgctctgtgtgcatagaggacagagggtagtttgtgtgcaggtggaacatggtgatgtgtttggtttgtttttttgtttttgtttgtttgttttgctttaatgccttttttttcctgagcgaagtgggtggatttttcttcttaaaaatatgtcttgatgtctaatatataatgcgatgaattcctgtctgtgttgtggttcttcatattttctttgcttggtttttaacttcttttttctttggaatcatagtactgatagactttttatactcttcttctcttgcctccccaccccctggccatcctaacacacgggcacacgtactctggacttcttaaactttgttcctgaactacttacggagagtggggttgggggatattggaaagaagtctgtgaaatatagcctgactcctgatcttcacctctgcccccacagacaagttcaccgattcagccattgccatgaactcgaaagtgaatggggaacacaaagagaaggtgcttcagcgctgggaggggggtgacagcaacagcgacgactatgacctcgagtctgacatggtatagcctccttccctgagaacttgggagctggacagacagaatgggttgttgacagtgaggttcatttgagtggggagggaaatatttactgttgcccattgatggtagtcagataacaaatagaaaggtatagaaaatagcaaagtaaaaatatctattcttagctgggtgcagtggctcatgtttgtaatcccagcactttgggaggccaaggccggtgggtcacttgaggcaaggatttcgagaccagtctgggcaacatggtgaaaccctgtctcaacaagatatataaaagctatcaaggtttggtggcatgtacctgtagtcccagctacttgggaggctgaagtggaaggatcacttgagcccagggaggtcgaggctacagtgagctgtgatcataccactgcactccagcctgggtggaccgtgtcacacgcaacaaaaccaaaacatcaacttactctcttactatctataattaaccactcctagcatttgcatcacgttatttttcaacataacaaaaagtatagattaatgtgtaggcccatttctcttcccaaaatcagctactctgaggcatttaaaatctcatgaggctgagcgcagtggctcatgcctgtagtcccagctacttgggaggccaaggcaggagctccgatcacttgagcccaggagtttgaggctgctgtaagctgagattgtgccactggactccagtctgagcgacagtgaggatgtctcaaaaaaataaataaaaaccgctcatgaatagagctgagcgtggtggtcccacacctgtagtcccagctactcaggaggctgaggtaggagaatcatttgaagctttggtgcactatgactcaacttgtgaatggccactgtgctccagcctgggcatcatagcgagactatctgttgagaaacaaatgtcttgtgaatgaatatattattgttttgttatgtttagtttgtacaagaatttgcttttcttgccttttcgaacttctcatggttgtacgtagatctagttctttgcttctattgttgtgtgctgttttcaaatatacacacacacgtgtacacagcaaattgtatttgtccttttccttaatcatctgcatttggttgccattattttgctactaaaaatagtaccttgctggacttttagaacatatattccccacgcacatgtgccagaatttttctgggatgtcttggaaatagaattgttaggtcttatgacttttcaggtttactagttattgataatttctgctgcagttgttagtaatcattaacagttgcaggccgggcgcggtggctcacaccagtaatcccagcactttgggaggccaaggcgggcagatcacctgaggttgggagtttggaactagcctgaccaacgtggagaagccccatctctactaaaaatacaaaattagctgggcgtggtggcacatgcccgtaatcccagctactcgtgaggttgaggcaggagaatcgcttgaacccaaggagacggaggttgcggtgagccaagatcgcaccattgcactccagcctgggcaacaagagtgaaactctttgtctccaaaaaaaaaaaaaaaattgcagttattaattacaattattagttgattacttttgccagccacgttccaattttttttccactcttgttttgtcgtttatttttgagacgagcttgctctgttgcccgggtttttgttgtagttgtttgtttttgtttttgtttttgttttttttggagacagggtctcactctgtcactcaggctggaggctggagtgcagtggctcgatctcagctcactgcaacctctgcctcccaggttcaagcgattcttctgcctcagccaggactgcaggcatgcgccaccacggatggctaattttttatttttagtagagacggggtttcaccatgttggtcaggttgatctcctgacctcaggtgatccacccacctcccaaagtgctgggattacaggcatgagccaccacgcccagctagtcgcccaggccagagcgcagtggtgccataataattcactgcagcctcaaactcctgggctcaagtgatcctctctcctcaatctcctgagtagcgagtagctaggaccccaggcatgcaccaccacacccggctgtttcattatttttttctagagatgagctcttgctgtgttgcccagtctggccttaaactcctggcctcaggagagcctcctgcctcagcttcccaaagtactgggattacaggtttcagccactgtgcccagccaatttgttcacatcttggagtttttaacctgatggaagggaagtgacttgtcgttgcttttcctgctgggttttaaaaccaccttcctccctccccagtccaatggatgggaccccaatgaaatgttcaagttcaatgaggagaactacggtgtgaagactacctatgatagcagtctttcttcttatacgtgagtatcttggtgctctccaggtgatgtgttggtgatatggggtcactaagtgaagacaggtttccaggtagaacatagtttttgctcatttttctctgggtgtccagggtcgccatccctactcctactctgccttgtggaattcttccctcaaaggttttaagcgtcttaagtgcttctcacattcccagataagccttggtgctctacctgggatgcagtcggtgcccgttacccagatgttgaagggattaaatacttccatgcctgaactggtgattggacttgttgaaatgtttttccttttttcctcttttgtcccctggcactgggatggtggtggtctgtgggtgctgtctcagggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccaggtgactgttgcaaacagccaggactacttggggcttctgggaatatcctggggcctgggcccagagttgatgagtgctgtggtttaagccttgtgaccatgtaaaatgtcatacacaggtttaggaggttgaggtaaagcgagattatgtaatttgcctaaagtaacaaagctggagcttgtagatctaaaaaaaaaaaattcaaaatttatgtgctatttctttttataaaagtgaaatataactacattatttgtgtcttttaaaaactatccctggaactacggtgtgatcctacttttgtcataggtcaggagttgtagaattgtggagcactggccaggttggttggctcagagttgatgtcacatgaggtcataagtccgtagccacagaacgttaaactagggcagatcttcaagtgggatggtgctggagccaggcagtgtgtgtatgtttgggggcagaagggggagactttagaagaagaaatggcttcatctttccaaaacgtgggttttgtggctacctggccttatttgaactctttcctcagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggtgagttatgaggtgactttgaggaagagggcagggaaggggatgccaaggaggtgggagggtaattggaggggtttgggtgtgttggaatgacgctgcatcggtgggaatgtaataggtcgtctgcctcctgacattttcttctcaaaaaaaaaaaaaaaaaccaaacaggcccttcccgcatgtccccaaaggcacaacggcctctgagaggtgccaagactctgtcttcgcccagtaataggccttctggagaaacttctgttccacctcctcctgcaggtaaagctttagtagtgttggatgaagaaatggatggaaatttgtaaagagatgtaaatatgtccatttgttacagtgctggaatgggagataattttaagatagatgttttgggcatttgggatttagtcatattgggaaatagttcttcgatttccctagtgcagaaatctcaacctagcaatccatgggttgtgtctgcttggcagacatcttttgtttagatttgaatcagttgctaagttttgttttgttttgtttttttctttttttgaaacggagtcttgcactgttgcctgggccagagtacggtggcgccatctcagctcactgcagcctccacccctcagattcaagccattctcctgtctcagcctcccaagtagctgggattacaggcacccaccaccacggctggctaatttttttgtatttttagtagaagcggggttttattatgttggccaggctgatctcgaactcctgaccttgtgatcctcccaccttggtctcccaaagtgctgggattacaggcgtgagccaccacaccctgccagttgctaactttttaaaacaggccgaggtaggcagattgcttgagcccaggagtttaagaccagcctgggcaacacggcaaaacccttctgcaaaaaataaaaagattagctaggcttgatggcgtgcacctgtactcccagctacttgcgaggctgaggtggggggaatcgcttgagcccaggaggctgaggttgcagtgagatggcatcacaccattgcactccagtctggggaacagagcgataccctgtctctaaataaataaatcaatagaagccatagaaaatttttagtttcttttgaattacaggaaattctgtcaactgagcttgccttgctgcgtagcttgagttgactggaacagaatccctgccactcctttaagcattccagttgtcgatgatgcccatgaggccatttacctgcttgtgttacctgccttgagcttctagacatttaagttggtgactctggttgtatagtgtgtaaactttcttgctgttttgagtaaggcccttgtactcactgctgttgaccagcagtaaccatcctacagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatggtaagagctaggtgtttgagtgctgtgaatgcatatttagtgtgatttgtggttctggacagaaggacctttaggcatttctctttacttgaacagtaaaagaactctctaccaaggaacctgggagaactctggagccccaggagctggctcggatagctgggaaaggtgagggtggttttttttctgctgaggattaatgctcctttgtctgggggagagtatttcagttaggaagtttgttggaattcagaggcaaacaatgtctatcagtccttggattataatttcacttctgtgatcctcaagagtttctcttttttctttgctttcttgtcctctgttcttttggcactgtgtagccaccttagagaaagaatgttttgtattttcttctttttgactgttttctcatagtccctggtcttcagaatgaacagaaacgattccaactggaagaactgagaaagtttggggcccagtttaaggtgagagaagagtgagctgggatattagcagggtaaaggggttgggagtggttcgtagatgaggcaaaggactagataggagtcaaagagatgagatcaaaaaaggatgaaagaagaaagccaggactagggtctgggtcagactggactgtgtgtgtttctctcttccagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgagtgagtggagcggggtggggctctgggaggatggcaggagggatgagagcaagccgtgaagatttactgtactttctctcacagacaagtaaagaaatcaacgttgaaccctaatgctaaggagttcaatcctacaaagcctctgctgtctgtggtgagctgggacaggagaatgtggactttggtttctgtggggagacttgggcagtgcttatagatgaatagggggaggaacacttcacttccaggaccacttgcctggcaggcagtgtgaggagatgtcataaaaatgtaaggatggcacctttggggctggcttggggaaaatggactcaggtctctaggtttgggtgatcaggggatcagggatcccagtgagtctgatgaggggttaacaggcttttctttggttcttggcatttggctgagggagtattggagtggggtagtcatgaacagaggccagctgacttggcttgagcccctgtatttggaaggtttgtgatcttggacgtcacttacattctctgcctcacctgtaactttagaatactcatctcctcatagggtttaatgtgaggctttatcaagataagtgcagaatatgtttggtatgcagcatttcacgaatgttaattattaccactctaggcatggccaggagtagaggggaaaatacaaaataaaattgtcctcccttgtttttgcagaataaatccaccagtaccccaacttctccggggccccggactcattcaactccctccatcccggtgctgacagcaggccagagtgggctatacagcccccagtacatctcctacatacctcagatccacatgggaccagctgtgcaggtatgcagagagactggccgggcccagggttagcggggtgggatttggttgcgctggttgagggaccaggtcaggcctgtctgggcattcgtgagcgagtcattcagcctcatctgtgtcctcatccccaggcacctcagatgtatccatatcctgtatccaattcagtgcctgggcagcagggcaagtaccggggagcaaaaggtgagcagggctgggaggggcaggcggcgaggctgccaagggcctactggcaggtggagcttgagctctcctctcctcctcctcttccaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacaggtgactgcggcccaggagggcagtgaggatccagggcccctgctagggatcccatcttctccagagacttgggagctggctaggggtggcaggcagtgttgtaggtgggatcggccctctgtggtattggcggtgtcagacttgggcttgagccctggctctggtggtacctgtaacaaggcattggacatctgtatctctgaagtgtagagaaaatagtgtctgctgggtgggatcgttatgaatgttgaatcaatagggtgattgtgaggaggcccaagcggtgctgtgcacgcagtgactggcaggaggacaccttcccagctggcggctgtgccaaccactcctctctctgtcccgccagccggtgtttgcccccatgcttcagagcaacccacgcatgctgacgtcgggcagccatccccaggccatcgtgtcatcctctacccctcagtacccttctgcagagcagcctaccccccaagccctttatggtgagtcctgcgcctggtccctctgctctgggctgtgtgccagccccctctggtgtgctcagcactggttctccctctttcctgctgcagccactgttcaccagtcctacccacaccatgccacacagctccatgcccaccagccgcagccggctaccacgcctactggaagccagccgcagtcccagcatgcggcccccagtcctgtccaggtgcctgccatggggggtgctgagtggtcctggtgcaggaatgggtggccagaagaagggatagagctaggggtcatttctgagtggcgaggactgggggccagcgagttgctggcctgtgtggcactcaaccttcccctccccagcagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggtaagagcccagctgtcccacttctgggtctgtttgccagggcccgtctgccatggggaccatcccattgccaagtccctggtgccacccttgccatagtgctccctaactctggctctcagagtctgtttcaggattctgtggtcttcccggctacttttttgttttccacaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 23 - DNA, 3059 bp, Artificial Sequence
  Based on Homo sapiens sequence
acacccctgccagcggcaccatggctttcctctggctcctctcctgctgggccctcctgggtaccaccttcggtgagtgccaggccctgcggaggccgaagggttttctcctctcactcccagccccgaggccagcaagaggcagcagggtcccagctcccagttcagctgtgcaccgcagtgtgggcctgggcgagtcaccggctccatctctgccgtgggcgctgagaggtcaatgcctccctcccaggctcagctgccgcctctgagctcaggagatggggagtcccgctccccttcctcacccccagcagacctgaggctctcaggggaggaggcggggggaggaggcaggtgtccgggggctgccctgaggccttcgggaaacccccaaacagtcagcggccccagcacaggtttgggtggtgaatgtgtgggcagctggggcttggcaccgttcagtccaaacctttcagaacctcgagcctcaccctcttaaactcctgctcacggagcacttcccgggtgccaggcgcagagctggcgctctgcctgctcactctaccaaacctgtgaggtcagaaacagcgtgatccccactttgctgatggggacactgagtggcttagctgggcagggagggagccaggttcaaacccacagagtctggcctcccagactgagcgccggggctgccgcccaccgcacgctccacctgtgtgacttctccgaactgaggtggggccaacaccccattcctcagcagcccacagcccagttcattggactcagttgtacctggggattccagctctgcggagaggagagccagggccaacttctcagagaaggggatgtgggagccagtctaggtcccagagactggaaaagagttgggagtgagaggaggctggagcattaggacctgggtgggtggtacccacccctcagcccactcccgcccccaggctgcggggtccccgccatccaccctgtgctcagcggcctgtccaggatcgtgaatggggaggacgccgtccccggctcctggccctggcaggtgtccctgcaggtgagggggttctgcaaggtggggggcaccctgggtaggggccaggctgggggtgcccccgggtgggaggtgctgaccctccccatcttgctcacaggacaaaaccggcttccacttctgcgggggctccctcatcagcgaggactgggtggtcaccgctgcccactgcggggtcaggtgaggaccgggcagccttgggctccgcttccagcaccggtcgggtgggaggggagcagggcatgttctctcacccacaacgctctgcccaggacctccgacgtggtcgtggctggggagtttgaccagggctctgacgaggagaacatccaggtcctgaagatcgccaaggtacccaggccccgtgcagcagagggcagggccgtgggcacggggggagacccctcggctgcttcagggacaggcgcccagtggggccgggccggcctcgtgattcccattccggccctggggatggactgctccttaacgggcaccagggaaggagtctgtcctcgaagcctgcaggtcctgcctcctcccagggcctcaccccggcactctggcccccacccccaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacggtgaggggccgcggggctgcctctggggtctgggctgcctggccgtggagtccccccgtgaccgtttggctctaaattccaacacgctcctaactgcccgttcgttattgaaaatcttctgaatttaaaatcccccaaatgcaaataaaatccaggtcggatcatgaggagcctgcacagggagcttctgagcagcgcccggccgggtgagccctgccctggctgacctgcctggagtcgcagcgtggggctcccacccgggcagggccgaggcccccttgtcccacaggcgcttctgaggctccaggggccgtacccaacatcgtggtgatggtgcagggtagggcaggcgtgtcggccccgggtctctccctccactcttggctgagtgagcccaggggccctgaccctcctcctgtcctgcagccaacaagacccctgacaagctgcagcaggcagccctgcccctcctgtccaatgccgaatgcaagaagtcctggggcaggaggatcaccgacgtgatgatctgtgccggggccagtggcgtctcctcctgcatggtgaggctggccctgcccaggccctggccaggcgagcggggtgcaggggaggtctgggctttccacccctctctgctctcatctactaaccccacaccctcctggggcccagtgagggccaggccttggggtcacagccgcccatgagggttcctccaggccatgcagctgaggctgcccctggggacttccttgcagccctgtgagctggaggtttggagagatggatggtgccccggcttagagagggaagccacctgccccagctccctccaagagtgcatggcagagtgggggctgccatgtgaacccagatctcaggaccccggcacagcccctatgcccatgcttaccatttctccgcacccctccctagactccaccaggtcagggtcccctaggccctggcacccctttcaggcctagagatacttcctctccttcctgcagggtgactctggaggccccctggtctgccagaaggacggagcctggaccctggtgggcattgtgtcctggggcagccgcacctgctctaccaccacgcccgctgtgtacgcccgtgtcgccaagctcataccctgggtgcagaagatcctggccgccaactgagcccgcagctcctgccacccctgccttaagatttcccattaaatgcatctgtttagaa

SEQ ID NO: 24 - DNA, 23326 bp, Artificial Sequence
  Based on Homo sapiens sequence
gcgtgtggcgcggggcggggcgcggctggtgcgcttgagaagcgatggcggcggcctgaactcacctaacaccgcagcagcaaccgggcccggccaggttcggcgttccgtgagtgaacggtacgcatgggccagagggcctggagagtcgtttgtggggatgagagactgggaaaagacggtgacgggtttggttactgtactggttgtgaggggttggcaggtggtgagggtccgggtgtgagtgtctaagatagggaaggagggtgagagcttacaggtgagtggacaaatgaggggctgtgagaggctgggtgctttcggaggtgccaagttgaagggactcctgaacgcggtttactagggctggggctactgagggctggtgtgaaggataccctgggactagagtgaggggtaaggcctgcgcgaggagagagagagtaaaaggcgcaggtgggagcctgcggggtggcggcaaattggtgagggagttgaaggcgaggcatgggaggagggaattagggcttgtgagacttggataaaggtgagaggttggttctgaggcctccttcgatggactgccctgtccagtgagagcaatagttttagacaaagtagggcagcttagatggaagtgttgtgcacctgactcctctgctcccatggactttccatattctggaggacgagaaaatgaaggtgtcataggcaatagtactatggtaatgaaagtcatatttgaggctcagacttcaacagagtaatcacagaaacttcagttccttcgagttccttctctggactgcatagttgaagatgggccctctcatgaagggttttgcgctgtgacagcttgtgttttctctctacttgcttctggacaaccttattccactgttgctccttacctgtgcttaactgtgggtctttgattggattgaccatattcagttgctaattctacttttatggaggtcatatggtttgccctatacagtactatatttaggatcccaaacaggatggccttactctcctttcttacagttgaattttttaaaaagctagtttatattatatttaaaatgtgtgtttgatgagttttgacatgtgtacacatctgtgaaatcatcatcagtctcaagatactgaacattttagccacctgaaaatttatctcttcctctccacaccctgtagttgggttcatcttactagcattcttttaggtcctcttctccccaccaacccaaatgcacgtgaaattctggaaagttggtttggcattcagtgataatggccactttcacactactaaattttcctctctactgctagtcagccatggggttgggacatcctattctttccagactcagaaagagttaagtctttccttaactctacagtggacagggagagaccatttcctgagaattagacagcctcagtccccattcttttccagagtcttagcttcagagccaactcctatatcctgtggtatattctcattgcttctttctggagtccagacaggcctccatattggtagaacacttggcaacttgcccagtcagtcagaacttacagttcagagtttagagtagtggttcctaaacactggaccaaggaccctgtacatgataaaattatcatctatccaagatggagggagagaaagacagtatggttattcatgaagataaatttattctcagagattatcattcctattcttttggtgttgcagtgctctttcgttgatgcagtaatggtaacagtagatggtgggttaaaaaaaaaaagatctaatttacccaaataaaaagtgtcaacccaatttttaattttaaaaattatttctatagctttatgaacttcagaaatttaaagtgatgatggtgtggctgttgtattaggttgaggaagcatacatttatacaatgattctgtataacttaacatctgaacagcattcatgctttacatagggatttcaaattttattatactgatttatatagataccttgtagacaaagacaggaactttcattttatagatgagaaattaaattcagtagccagagatcatacagggatacagtggcaaggctgaacccagaattttgtctcagagtgagagagactttgggaaagaagatttataatagacactgaaggtgatgtgggaggattttttaatgatttgtaattgttctatttccaaaagacagaaaagggactgtgagagtgacatagggatgaaggttatgtttaatgctgtcgcagtgacattggaacaggtatatataatacctggatcacatcttgatagtggatcatatcatgatagtgataggatgaatcaaatcaaatattagatggttcttagggactgtctaaatccttgttataatggagaaagcactggatttggtaagcttattgtttgctatcccaaactctgttgaaatagtagtgcattaagtataatggattttgatttgtatcatatagtgagtggtagttctgagaggatgaaacatacatgaggatgatgatgtagagatagaaacatgtttagggtactgtgttaatcatttattccatatctgctctgtgccaggcactctactaagtgctaggagaatgaattcgtttattcattcaacaaatacttcttcaacatatagtctgtgcttgtgatgctcacattttatgggataacaacatgaataaaacatggtcatccgagctctcaagggattttcagtctagtagggagagagagacacatgaaaacataatttcaatttagagagataatgtgaaatgtgaaaatatatcataataggctgggcgtagtggctcacgcctagcattttgggaggctgaggcaggcagatcgcttgacttcaggagtttgagaccaacctgggcaacattttgaaaccctgcctctaccaaaacaacaacaacaacgacaataaaaccaccaccaaaaaaacccaccaaaaattagccaggtgtggttgcacatacttgtggtcctggctactccggaggctgaggtgggaggattgcttgagcctgggaggcagaggttgcagtgagatgaggtcacaccactgcacttcagcctgggtgacagaggccccacctcaagaaaaaaaaaaaaaaaaaaaagaaaatatatcataatgagttgattactcctttgtatctagtgtcatctttccctgtattccaagtatacatgtttattgatctgtgtatctccacaagtatctcaaaattaacatgtccaaaacagaattcatagtctttgccccaaaagcccgactttgccctcatatcccctatctcactccaggcaaggactacattgtcatctttcatactttctgctcttttactccctgcattcaatcatttgctagaatcttaatacatttcgctctgtgttatctctcttctctatatctccattgctacatcttcactgtcaaagctttagtttagctccccctcacctcatatgatttttttaaaacaattttttgtcttaaaacttgctattttctggtccatccctagaatgatttttctgaaaatacacatctgatctccgaactccttggcttaaaaacttttggctctttgtgtcctgtaggacaacatccaaatttcttaatatggcatcatttagcttcagcttacctctccagtctcgtgtgccactccctagtctgtattctagtttgaataaattgttcacagttccctaaaaccatgctgcttttttgagccttgaaatctttgtaatagctgcttcctctactaggaatgccttttcttctctgcccagtgaactttccttatcctttaggatctagttcagtttcacctcctttttgacatctctgtcaaggtagagataactgtgtgtgacatgaggattcattgctgtaaagaggagtcactgtagaatagaggttcacttttgtgaattggatggaccccgctggagtcagatgaggagatccctgcaagaagcagaagtgatattgcggggagggaagggaatgagttgggaccataccctgacatcccatttgtctgagggatggaaaagcagggaagaaatgtgtaagctgagctctagtataaattcctagtaggtggtgtttttggttggttggtttttccctttgtatttctatgagattttaatcaggtcattcaacttccagtatttagggtaacagcccattcatcctccttatgtcagtaattagtcttcttgcctaggaagagccactgtaaggagagagacaccacagaattttactgacctgttcttggaagatcattttggtctctctgtccaatgtaggtgttgcaggtatatcccttcccccagctccctcctctttgcctctcccagggcaaaggttcataagtgaggctgagccacttcctgccctgtatctgcagttccgaggttggttgtcacccttgctgtgtgtggctgtaaggctgtattttgggctataaggtgagtgcctgatcttggccattttgggtctgagagatcagctcgttcccctttttactctgtggctgagcctgaaggtaaatctggagagtggcaggttctgctttttttttttttttttggactttgctatgggaggaaaggacaccatgagagggtggtgattttaaccttttctttgtcttgttctgaacattgcagagagtctaattaggtgataggaataccaaactatagctttcttttatgcttttgttgtatgtgaacagggcccagtttaagtattggcttttggaatctgagatgctgattccaacatcttctcttgaggtctttgaaatgggattgtagaactgcggtgggcaggtgggtgaggaagggtcctggaggctaatcttccttggttccatgagcagtaccctttgttggtcaagtggtggagcaataatgggcacctcaggtatactgcaaggtaggagcagttaatgtttgaaattaaattccagaagctggaggcagtttagttttggacatgttaagaccttactgagactgaatgcttggcctttcttcagctgactgaggtatgcatgggaggcgataaggatggacacatcagagcaggttatatctcttttctcagtcagagatatgggcacttgggtcaaataggatcaggagaaggaagcaggaaagggacatgtaatttacagagtaccttctttatggttggaatgctacataggttgttatgtgacttaatttttaaaactagcaatacttatttcatcaggaatttatagatgaggaagctgaggctcagatatgtgaaatgatttatttaaagtcacacagctggggaatggtggactgggattcaaaccattgagggactccagagttcagactttacctactactctgtattattcttgtttgattgtctttgttttcagtctttaaaatgagatacgattgagaaaagtgttccataaacattaatactcttttttcaatgaggctctttgcaggtggcagatagctcaagctgggtttgggaagagtttaataaagggaccatatttacaaagatatggatagggtttaaggaaaccaacaagggatggtacagtatcccagggctaataactgtaagaggggctagccataggggagagtgcttaccacttttctcaaccgttgactttatcttttccagtccatgcctaattgggaccataaatagctgggtggataagtacttgtccagtgcatccctgctgatggctactagtctttgttgctgcgttaatgatttattaagaaaccatgtatgaaagacttagcagtgcttctgtggctttgccaccttctcacccattttcttctctctcacccccattcttctagtgagtgagggagggaaggtggggtggggttggtggtggattggatgttagcttctgtctttcttcatgttcagatttgcctgaagtagcatccatcctttatttattactcattttttcctttttcagagaaggtgtcttacctatttttctgagtatacccgattttaatgccatttatctctatcttatttatttataacttgtcactttcttcagactactgctctcacttgacagacacccttgagcctccccatcctacagcaaaatcaaaaggctttttcttgactccccttaccacaacttctttaagctattgccctatttttttttttgagacagagtttcactcttgttgcccaggctagagtgcaatggtgcgatcttggctcaccgcaacctctgcctcctgggttcaagcgattctcctgccttagcctcttgagtagctgggattacaggtgtgcaccaccacacccagctaattttgtattttttaaaatagagatggggtttcaccgtgttggtcaggctggtctcaaactcctgacctcaagtgatctacctgccttggcctcccaaagtgctgggattacaggcatgagccaccacgcctggcctaccctatttttatcctttctcattttactgaatttcctgaaagtacatcttacatttcgattcctattctttaactaactaatttgactaagtttgtaaaaaacttgattgcaccatttttagtcttcattctacttgatctttctatagaactatacactatgggcaacctccagtttcttgaaacttcctttctttgatgtctagatcatcgttatttcttgggtttctccttttatttctggctcccttcaaagtcttctttaaagactcctcctttttaactttcctacgtcctggttttccccatgattttacccttacctcctttcatgatctgctgttctccttggataattccatctacttccatagcttcatagttgtctataagctgctaactcttgaatttgtatcttttgtcttgattttattcattatctcaagtatggtattcctacttgctttctggacatcatgaatatcctgtagatgtctcaaaacttaacatgttcaaaactgtactcaacctcttttctaaaacacaattccccttcttatgtgtttctagtctgttaatggctttatcttttactgaatctcctatacttcctatgagagtcttctctcatcccccatttgtttgccaggtcttgttgcttttactttgcggttaatttaaatctggaggcagatattctgcatttgcattttagtcctgtcactagctgggtaatgttgggcaatttatttaacctctctgggccttgatttcctcctatgtaaaatgtggataataatacttaaatgggtttttatgaggtttaagttagctacttcgtgtagtgctggaatggagcctggcatgtagtaaatatatgtttgctgtaatacttattaattcagcattcaatttcaaaagcatatttgagttcaggctgtatgtttgcactgggatttcaaagaaaaatgaatgctatttttattttgtcaaggaacttgctattgattggcagaggtattacaggtataaataatttcagtattgcatggaacatattaagatagaggcgaatctcagatttatctttcctaatatttctcttagttcatgacattactttcttattttcaaatggactattgaaacagcttcttataaattgtccactgcaatccatctctctctgctccatcttattctgttacctgatgtatttttgaaggacaatctgatcttaccattttcttgtttaaaaacctcctttgtttctagggtgtcagtagacaaaagctaaactccttagcataatatttagcaatacttataaccgtcacccacatttacccttcaactaatgttgtgcctctcttctctgaatagtctgtgattaaggcacactaaatttgcaactgttctttgaatttttcgtgttctttcacggtaccatagttttgtacgtactgtttttaatatgaagaaaacctttccctctgctctctgcttaattagtatctcattattaaagatctaagttcaatattaactctgtggaaccctctaatagcccaggcagagttagttgttttccttcatgcccccatgacactttttataaatacttctatttacaatatttgttggatttatgtttatgctacctcaactgtttttatccatctttgttatttccagtgcttacttagaacagtgcccagtattttatccatatggatatacattgagttaatgagtaagccctacctgctctttaggactgggcccctccctttataagactcacctgttctatagaaattttgcttaaacatagtggctaccttcctttagttgtgagctggaaattgtgtgagagagtatctgggtgaagggagatattgttaatataaccttagggcaaaatgtggggctggtgccaggtctctggattccttcggcctttgttgagtataaagaggaaggacaactgaaccacccctttcctttcaaggttttatgcttgtgagagacagtactgatgagggtgtggtggctgtaaaggagaaggaactatggttccttctccaatagctacttggtacttttttcctttttcttgtgaggatgtcttaccattttcttgggagcgagtttgggttgtgtctggcaggagtggagatgggaatgtgtctgtcttccttactggaaaggaaacagctcttctttattggttggctctgaattcttcctcttaagagtattcagtcagttaagggtcttatttgctcatctcccataggtcactgggtaggtttctagggaagcacctgtgatagacagaaatttcttcttcagtagtcccagagggctagagtcagatcaaggctggatttcttgattgattgttcattcattcattcattcactcacttatttgcttcagcattaatacgttcaacgaatatttattgagtccctaggccctggggatacaacagacacaataagacaaaccctgccctcaaagaagctacctaatgtggggaagatagacaaataaataaatagtttcaggtagtgaaaactgccaagaagaaaggattaggaagctagagagtgaaggtgagaagatgtgctatttagatagaattgttaggcagggcctatctggggagatgatttgaaacaaacaaacaaacaaaacgagcaatgacagcaatgtgaaaagcaggagaaggacattctagtctaggcagagggaacaaaaagtattcaagaaggcctgtgtcactaaagtgtgagtgagaaggagaatggtaggaagttatacagattagattatgtaggctcctgtaggccaagataaggaatttgaactattacagtgtgttaggaaattattggagagtattcagcagaggacaggtcatataatttaggttttaaaaatatcactctggttgttttgataactcttaggaggatagtaaaggaatcatggagaccagattggaagctactgcaatagtgagacatattttgaaggtagagatgatagagtttgctgatgaactggatattggaagtaaggaaaagaaaaaacaaggataatgtacacattttcagcttgagcatttaggttaattttggtatcattttcttttgagatggagaaagttgaaggagtaacaggtttggtggtagaaatctgagttctgttttagacatgtcagttgctgattgtgtgtatgtgtgtatgtatatataggtgtgtggagttttcagtggagtggtggttctgagttctggaaagtgagcttctatttatcccttccattatctcttctctgaattagatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtaggagactgtatggcaaagggccttgtctgctgatcacctgagttctcccagccttctatattctcctcatcccatttagtaaccttatcaatttagattccttccatcttctgtcctttttccctaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggttagcaccccctggcttggagggtagggtgtggtgtgtagatactgaacagcaccttcctatccaggagatggggagaggctatgttccagggcccgttcccctaggaaacagttcctggatttgaaagcagccccctggagttgtagtggggatgaatcatgggcttagatggatagggcagatactaagtctctttgtaggcctgtgaattctaggtgagtttcaggcacattgggtaggcaaatgcttgctttggtaatagcttatacccctattcccatcaaaactctggattactagctcccctgttccagtttttatattttataaatgtattttatatatgagcttttggtaacttctcataggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtaggactgaaagtctggcccttggtcatttttgggagattaggtaggagggggtatattccctggagttctgtcatttttccatcttggaagtaggatgcctctctgtagtgtactattctactcccttccaggcagtggtctcctcataaccctcccccttctctctggcactcctacaggtggctcaccccctggtgcagaagcagttggttgattatatccataatgggttcctggtgcctgtcatgggtcctgccttgcacaaggtgagagtcatgggtggcaaggcatataaggggctaagctgcagtggtaacctcagtgacaggactaacgtaggaggcggtgggtagagtactcctcccttttgccctgtctgctcctgatttctcttagaatccagggaaaatggccctgtatgtgcagggaagctgtgcatttccagactttcccttctttttgtgcagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccgggtatggcccttacccctgtcctagcttacctggatgacccatcttctttctctgacctttgttctgggagggtattcctgcccttcttttgcctgtatctccagcagtcacctcaaaattaagtggcattaactttccagcattaaacttttaaccattttgggtacagattttaatctactcccctgcttttatgatagatgaatctagaacacagtcaccttttctggatgactttggctgttcatcatgactataggttttgctactgtgcagtgttcgtaatgtagtattggcctgagttctcttaaactgtttatcactctgtggcctgctttgggtgacttgagagcactttaggttgtgtgtctgctttggtaggtgatccaggtgctactgatatgcttgccttctttctcctttggatttgctgcttttgaactatagcttggagcactcatccacccacctatctactttcggtccttcctcctaaacatttttactgaatgttcactgtgtgccatactgtttgctggtgctggggatacagtgataaataaggtagacattgttgctgacttcatggagcttactttgtagagaagacagacaagcaaacacattaataagttgtggtcagggttatgaaaaaactagagtgcttagaaataatagggtggccaaggaagacctctctgaagagatgacattgaactgagacatagagattataaaggagttaacttattgatcaagtagaagaacaggaaagcaaggggaacagcatgcaaaggacatcaaatgggggaagagcttaacatgtttgaggaaatgaaagactagaggtgtagtgagcaaggggaagaagggaatgagataaaaatagaggggtaaaattcagatcatgcatgacctggaagaccatggcaagaagtttggatattaacaaatagaaatatatataacatgggagtgggtggtttccaagttataaagacttaagcccctctaggagaataaagcattaattttgccatggacttcatggcatttattttgcctctgggaccatttttgcttcctttttttattataagttaaagtttcctggatccatgtgtttaaaatagaagttctttcatcactaagagctctggaaaacttctagataatgagatactagatagtagagttccaggtcagtttcctggatagctgtgttttgtataggtgcagtttctgaagctaagttagggtgtataagaaatattccagactgactgattaaaccagtgtttctaaaccaagtgtatactttagaaacgtctgtgaatctttgaagatgacaactaacaactacaacagattctgagctctacctcagatttcgtgaatctttgggagtaggctcaggacatgtgtatttttaaaattttccaaaaagtaatcatgatagatgccttgggttaagatttattggaaccaatagggaataggtattaaagctttaattttacaaagataccaaaagtattttttttccctcattatgctgaaattaggccatgattggcctcatattgtcctgttcatgtttagagacagttgattttctttttgaggttttatctgttgtttcttccttttgtcttatcctaactttgattcttactcactatctttcatttttttagtagttgtttctattagtctcccatttggtcccctggtcttaggagccttacatgttcttgggatgtttcttcttggttcctggttcttggaggaacagatctcttctaatttcaggatgcccgtgttaaacatgtagatgctttcctttccactgtggtcctttcaagcttgattctttggcttgactttgtaacgtatatagcctgccttgtgtgccttgaagtgactaattttggctaaccagcctgtgttaattccgtattgctgtcataacagattatcaaacctaatgcttaaaacagatttattgtcttacagttttgtaggtcatatgtatgacctggatctcgccaggctaaaatcaaaattttggggggtggggtctgtgttcctttcaggaggccgtaggacaggatccatttccttatttctattggcagaattaattttctagcagttgtggcattgagatctctgttttcttgctggttgacaactgaagaacattctcagcctgtagagcaaccagattccttggctcatggccccccttcatccatagataatagatatctatggatctctattatctgtggatatctaggataatctcatctaggatactcacatctgcgaagtcgtctctgccacgtgaggtgaaatatttttagggtctggagattaggatgtgagcatctttgagggaccacttttctacccacttactacttttcagtgagtctgaattttttcattgctagctaaagtggtcatttaggatagcctcctgaacatccatgctattcaaaatgtgaactgctgtcacgtgtttttcttgctgtgtggttgacttttaattctcccgtggtcatgtagcaaataatgaatgcctaaactgttcaggtagtgccctagaccaagacccattcgttgtcttcagggagctcaaggtgtctgacacacttgctgtaagggaagtatagagaaagtgctaggaagattcagagaagtgagggaaaggttacatatgtgttttctttacctagtcagagatgaaccaaccttcttccttttctaaaataaaagatttcctctaatcttgacccacctactttttccttttcctgtcagctgcgcttgagttgttctttatcctgccttctgagagatacactagtgttagagaggtgactcagacttcatgtttgcagccccacctacttcccagttgggaatcttcccggttccctctagtttcttattggtaggcattcagttactgtattgctacagtcccttctggcaggcattcacttaattaccatgtttctgttgtctcctgttagtcattcactcaatcacagtatttcttagtctcttctcatggattttcgttcaagtgttgctggagtctctgctgaccaggtatatatagctagagagtctatagaagtccattgggtctgagatgcttcatttgtatgaatagcaaagtcttgctcgcaaagatcgtgtgatcatctagctaatacttgaatgacttatgtgccaggcatggtacatggtcctctaggagttcctctaggagtggttggttgggccaacttggggctggtggggttcccgtttggtgaatggcttggagggcagagagctcttatggtgactccctccctcccctccacccccccagctctgcatggtctctctgagtctcttcaggaccctcctgaacctcagctgtgaggatgtcctgctgcagctggttctcaggtatctgttggggcagggctgagggatggctgaccctgaagcctcagagtcttatgcattgctggggcaatgggctatataggggttactcatgagtttccacttggagcctggcttaaccatgcagtttcattggcctgatgttcctctaggccctgtccttccttcctgatctaccctgtgtcccctttctgatgtctttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtgggcctagcagagagacagggagaagggaggacatcacgggtatggcctaggttctgggggagcgtagcaaggaggggctggggtgaaggggaggaaggtgtccatgaatgatagtctgtctttggggaggttgatgagggtgtcttgcagggaggacccttaacactcaccaaagaaaattagagtgggacttctgggcaaagctattcttgttcttctctctagtcgtgtactcttcctgtttccattgtgtcttcagtggtgatggtggtgagtgggggtggtggatgaggataaggttaattaggaggttggagagttagctgtctgaatagattccatgtttctgcctccccattgtcttctttcttagtctcccgaggtgtcttatctctccttctgaacctctgtctccttgatttctcttatattttttccctttgcaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggtaagctacttagcctaggccttcccttctgtgtactctttgcatgttctcgacatgtttgtgctggtttcttggacctcttggccatgtcatttctgtgtacttgcctagcccctcatccatcctgcttgcatcacttccagatacgtgtcatgtcatacttgtgtccctgtgtctgtctgtacgtcttccatgcttgtgctggtttgagtattgacttacatctgagccttgtatgtatgtcctatgtgcatgttcctcctctttccctagtctggccatttcctgcgatttgtaattaggatattctgtgtttgatgtttcctggtgaatcacagcaatatttctgaaccatattgaagacgtatgtgctgtcctgtatggagaggcacctaaacactctctatgccattccgtccagtttatctgtctgggtcttgggttttctgtcagctctcctggggcctaaggttaaccttctggtatttttctccctactcagctccttcctccccacctcttcaaagaaggacttgatttcaagtttttcctgttcgctttccttgtaccttcttggttgctgtgactgtctgctagcactaagactgtcttaagcagatagagtgcaatttctttgaaggcaaatgacaaagcgtggccctgagctccctgactgagttcatttggactctcaaggatgccctggagctagactcgatctgagtggttggactaactcctctttgtttttgtatgagagccagcttaccccgccattctaaacctcaggccaggaaaaccaaaaaacaaaaaaaccaaccaaacaaaaaacaaacccacctctgagaagtagtagctaaggctaagatcacaggccttggattaggcataccttacattagcctcccatctctgccatagatgcatataaatcatttactacaattatggcacattgtgagaactcagcaagtggtagcttttcactaggatctctgggtacatagcagatttaagttgactaaggcaaacactcatcttccagttgttcatagtcagattgtcatgccttgataagttcatgtcctgactgggcctgggagatgctggccatcctgctcatacagcaccagggcttctgccatggagttgtgccaattccctcttcttgcctcctacagaaaatctatctttccatttatttagcctctgctctgttcctttcagctcagtaccactaggtgatagcgtgcaggttttaccacagtcttgaagtattaattgaagcttttgtctttttttcctttggtaaacttatctgagcttttcaattttttttttccaagaaacttccaggaaatgaaaggaacaggacaaaattatggggcgtcttaggactctgttaagctagagttgttttgaagctaatgctagacatgtgcacctggagtgaaaaatgttttagcatctttttcaggattcactccctcctgccctccatcattctcctgtctcaatgcatagtacagttcttagatatatactccctttccccaaaaaaatccctaatcagaaggactgtgatggttatagaggcctactgctggtgatctggcttagctgaggtcagttttcccagtggataatgctgatcctttcccttccttctctcccaccaaagagtctgtcctcagtcagtttctctgcccctgcactaagctatccttttactacatattctgttccaccgtcttggttcccagcttctgaaagacaaaactgatgtcttctctggtcctccaaatatttttttccctaactttaaattggctcacatagttactttgtctttgcaacaccatcttctagctttctttctgagcaggtttagtgttatcctccgttttttgtggaacctaattctttttggacctaattactttctcaacctatttgttcttctgttgtgcctcttgggtgaatcttttataaaaacaatatgtaattgtagcttatggttataactgaacacttaaaatttgccagatctgaggctaaatgctttatattgataactctttgatcctcttcatcaccttatgaggtaggtatattttcctattttacgaactaggaaactaaggcttggacaattttgacctgtccaaactagtaaagggcaaagccagtgaaaccagatctttcagagtccagagcctaagatctggcttgtcagcttgaatgtgtgtaaagctggcatctggaatcttgtgggtccatatggtgtctgccatcttatttcctccagaataggtggccacgggatatttaaacatacccagaggctgacatacaaatacttttcatctggtgggggtctcttgttttggggaggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgtgcgatgcatgcatgcatgggtgcgtccaggctccgtggtgggccaggcccgcagctggagtgaccctgggtgggctgggaacaggcccagtgggactagaaaggactgtatcagtctagagctgctcagaaatgtcacgaaggtgtgcttcataggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctaggtgaggcctatcccaccacacccgtacctgccctccctagatagcctattaacccaggttaattgagctcttattaagagtgaaatgttgtgccaggacctagtgagttgtagaaaattgagtcttcatgtttgttctcaggcttctggtcaggggacagaacatagttctatctattaagagccagatcagcagttctagcaaaaactactctagaatttggggacaagaaagaggacagagtagtctctaggttgcgatattattacagcttagtaaaggacatgacatttgacatgggccttgagagatgggtaggacttaggtaggcaaaggagtggggaatctttttttttttttttttttttttttttttcaggagaggtcctggactgtttagttggagtaggggatttaaaagttggtggaataattggcagtaaggctggagagatttggctggagctgaatttctcagagtagaagttgggatgttttaggcagtgaaaaaccactggaagttctaaatctggaagtggagagattagtatgttagctcagatgcagtcaagctaggagaaaagagtcaggaagcatcaggaggcttctgctataatgtagatgttaccagggaggcttgaattagaatagtggacgtggaagggaagcatttaatgaggcagaaatgagaaggaagtgttggtggagtttggtgagtggtataaggaaggaggaagaattaaatatcgttatgaagttttaaatctagacttttcgcttaacaggtatcttgaacatttgcaatgtgtgccgggcattgtctttagtacagggaattcagggaggtacaagatgtaatttctgccttcaaagaatgtacaatctggagagtgactagaggaacgtaataccagaaggagcaaggtcctaaaggtgttgggagtaatgggattgagagcaatagaaaaagattaactttggacaggaaaaggctttttgtttttctccctttgaggaaaatgaggagagagcaaggaggaattgacatgtgccaatgtagttgtgaagtgtagaggagtaagggatttcacatcattcattatttactaatcgaagtagaaggcaaaatgatatgctgaaagcagagatggaggcttaatgagaaaagtgtatgggttgggaagagagtaccataaaagttactgcacagctgtgaagtctcaggtaaagttcttttgcatggtttcttcatggtctagtattgtgaatatttcttccttctacagttctggtgctggggtcactttagaggggccaggtagacaaggtagacaagacacagtctaggcccttaagttcacaggttagtgtatgaggtagaagacatagaaataaattaagtatgttgagttaagggaagtaaaattgggagtcagtggaagacaaatcagaggaggcttcctagagaagtggggatagtaaaatttcacgtagaatgatgaaaaaagtggagaaaagaaaatttaggcagagggagctacaggcgcatgaaaagtgcctgaagggttccaagatgatagatgtggatgcaaaagcaaggtggggtgtggagagtttgaaaagaaattgtaggaggagtgtgagcctgattgtgaagggctctgaatgccaaatttaatagctcggtatggtatttctgtagccagtattagatgtaggaaatgggaattgttattatgatctaggcctttatagtagatatggatccagacccagaaatctaggcagaatgttagaggcaagaggacgttgttttgaatggctcacttgagcctaagctgacttgaaattggccgcaaccagtgggagagaggctttggtgcaggacagggactggtgaatggtgaagtggtgaatggtgaagagcatattttggagggacagtagagcatgacagaagtgaaattgtcactgaactataattgcatatatagcccctgtggatattgtaggagcagaggatgtgggttgggtgttatagataggctggggaagagggaagtggttgactagttcggaagggtgatgggaagcatgaaatcagggcatgctatagacagaggagaaatagcttggtggtggtagattagtgattggaaataggagaattcgtcagggtgagagggcatggagaaggaatggatcttaactgggaatgaagtggctaaagtgttgattgattaagactgagaaggatggttggctgggtggggaggctggatagagggaaaaaggctgggcaggcagtatttttggtgttggagtgagaaagaactcctcactctactcctcagagtcaacttcagggatgggacaggaaatggtacctgaggttcatttctggtccattttgtccttttttccatttcctcagaaccctaaaggagaagtccaagaacctagggggtgggggaatctcccctctcagtccaagggaggttccctgatcccagcaccttcatgatacccctgtttattcccagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctctattctgtg

SEQ ID NO: 25 - DNA, 19154 bp, Artificial Sequence
  Based on Homo sapiens sequence
tcctctggccattcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcaggtgggtataggcaggagcggccacccaggactggggccgacggggcctcctgcgtgcgggtggacagcccctcgttccagggacactctggggtcctggggcgctgaggtcccaggtccgtgtggtgccgagcatctcgaagcatcatggctcggagcccccaggtggctgctccagcgtccggagagtctgggatgcggacatggtggtgtgatggtctcagcaccgggaggatgcagaagaaggcagagtgtgggaggccaggagggggcaagtcggggctcagggaagctcagtgctagggagtggcctgagggcaggaggcagagaggtgcgggctgtgagcggcagggaagaggctgtgcaggggtgctgccagggcttaggttgccagcttgtggtcgccatgcagacatttgcccaggcccgtcctggccttgccatgcagctctcgcacctgggcctccaacaccgccattttgtagagatgaaaacgaggacaggagggcaggggctcctgtatggccagcccgagtgtgttggggtgggggcgtctaaagcccacgcagccttgggggccagcgtctggaggtgcaggacagaagtggacaggggctggactggggcaggacggggcaagagtgaggggctgggcttcatcgcgtccccctggctggaggctggagaagctggcgctcgtaagagcccccacccaccctccctgccctggacacggtccccctgacttgtgccgtctgatcaggccttggctgcccctcctgaagtccacggagggacatggggcaaagcaaaggttggctgggtggagaacaggtctgggggcatggtcagggccacagcaagcaaggggcagcggcttttgcctccccaccctgccctggccccgtcacctcccaaggagggaaaggtgatgcatacgtgcccgaagaaactgaccgcataggttattttcacgcagcccctccaaggcaggcactaactggacacctgctttgcgtctcagctgttgaaatgccatcccctgcccccagcacacccctgcccccagcacacccctgccaccagcccctccccgcaacagaggcaatgacacaggccatactggggggaacagaacagccttgtgttgcttccaggcgctcagcagaaaaccaggtgcctcagtttccccacttggagagtgggcctttccagcgcacgtcggggggcctggaggtcaccctgcctgagggtgttggggcacccatgtgactctggcctggggggacaggagggaaatatgaggagctggggagggcctgggtgcccgagggtgagggggcagctgtgggccaaggagggctgggctgtcacacccgcctcacccacgtcttgggtttctgggcagaaacgtcttgcctatttctggacacctcagctgccactggctccttataaataacccaccccaggcgagggccacgctgcccccatcttgtggcagccgacaggtgtctgccccgccagcgtcgggctgggcacagcagggcggggccaggctccgctccctcccttcactgaccctcctcctccttacagaggatggccctagaggagtctgtggcgtttggggcctgaaccagctgggaggacagcacgaggggctggtgggcagcctgggactgggtcacaccgggggcctggacaacactggctcgtggggctgaggactgaggagagcctggcccagccgtggcagttacaagaggcttaacctgaggggcagcagagtctcaggaagagattctgggataggaaaaagctacccccgttgcctggaagacagctatctgctgggtaattttgcatggagcttaagttgctctgggaaaattaacattcttgacagagggtttggaaaacggttcccacctcagcagtgcaacgtagatgcatttttagctgatgaacgtgtgttttccttatacaacactcccaggggggaccgtagctattgtcttcgagtaatctgtactgtgttgtaatgaactttgttttctaaaaccctggccaacatgccggtgcagctgctcagagcctccccaggcctggccgcccagtgtgcacggtggccagctcacagagagacggtccccagcatgctggcctggcgccaccaccgcacatggacagggcagccagtcctgggcatggagcttcccctagacagggacagatccagagcatccccgggaccagggaaagcggccacagggagggaaatgggggggctgttctgtgggctcctgcagtccaagtatgccttgtacagagcccggcccgggggggtgcacgggaagcggcccagacccaacccaacgtgctctggggctcagcctcaatgttttcagggtacaggggtaacaagaaggaacagcttccctgctctgtgatcttggaggaggggtcctcagaggggtgtggtgggacacactctgggcaccccataggaaaacaggcacagaagggagctttgggctcaaatagggaagaggggttctcatggggaatggtagggtgagcagattactcatcttggggagccagtctcggtcatccaggggctcccagggagaccccacctacacccactgggcagagaacacccagagacaggtttcagctccatcagcgggacctttccagtgtctagagcgggctggacggcacacggcctgcattctggatgaccctcctcaggggacgccacggagaggatgtctgccctgggtgggggtggacgccacgaccttccaacatcccttccagctccaagattccaagctccagtctggagccagggcaggaagaggggacagagtctggggcgccaagagctgggaggggccaggagccctggagaaaggggaggcccaaggaggtggactcacccaaggccagagctggcccccaaaccctgcccgcggtcccccacagcgctgctccaagaccccatcccccatcctacacccaggcagctcgtaactctctttccatcctctctctctctctctctctgaatctctctctgcagaaaccacccaccttcaccatgtctgacgaggaagtgtgagtacccagctggtggctgccccctgcctggctcgggaccctggccccttggcttctgtggggctggagcatgcgctatcttgcacaagtccaagcaaagcccagcctcactacctctctctctttctttctctctctctccctgccccacagtgaacaggtggagggtaagtgtaacagccattttctttctacttcctgctctagaaggaaggctcacatgtgggcagggggctggactgtgcataccctgtgtccccttgacagccctacatcagctgcatcccatgggtggcttctgagtgacccccggaaaacagctgtccaagtggggggcctcgtcttttccccgaagtgtggccacatggtcctgaggggcctgcaggtcaggctctgggtcctgtctctctgcttctctcatgcccactgtgggacgtgggcatccaggacccccgagccccccaaaagccaccatcatcaccagagcctctgccttccccagcgcctcctcagggcccgaggacccctgattccacgctcttgggcaggggcagtcgctggcctgtccagggccgggacacactggcctctcatcctcctcctcccttcacgggctgccccttctaacgtggttcccctctttgttctgtcccaatgcagagcagtacgaagaagaaggtaattctggcaaccaccggaagcccccccagcccctccttggaacttaacccccctctcccgtgtggcgctcacagaaccccctccccaggctgctccaggccgccttgagcttgtcaatcaaccttccatcttcctcatcattagtcactaacaatcaccattcatcattaattaatgataaatgaggccaccacttaattaatgatggatgagtcattaaatcatcactaacccctgtctctttaatcgattaatatgcattcacgatccttcattaatccttcatcctccgtgtgccatggtgtgtggagttcactggggctggtcatgaaggcctcaaaacaccgagtgccctgcgtgcccagtgctgctgtctctctgcctctctctctatctctaccctcccggcatctcagagtctctccatctctctccagttcctttccgtgtctctcttggcaactttgtctctctgtgtgcctgtgtatctctcagcttctctctgtctctgtatctttcagcctcttggtctctgtctctccctgcctctctctctcagtctctgtctttcttggcctctctgtccccatttctccacctccatctccatctctgtctctctgtgtctccatccctccatgccaccccccaaccctgtgctgtaaccctgggtggagcctggagccccctccctgtgctggccaggtgtggtctgtgggcgtctccatcgtgcccgggcaggcgtgggcgggtgtgggcgcacctgggaaccgtgtggggtggcggttctcaggccgacggcgctgccctggaatccctggcacccactcaactggggagcgcgttcacgcaaccttagcaggcagggctgtcctgtgaggagtcctgagtgctatgttttgaaaatattttgaaaacacttggctaccctaacaacgtgagcaaaacatttatttttctgccgaaaaggtggaaagactcatttctgcgagggaaatatggcactggggagccatcttttctcttggggcagccacgtggcaggccgggaggccacggaagggtcttcgtgcgacatgtctctgaagacccctcagtgccagccttgtttccgggtgcactcagagccggggcttcccgcaggccctgtgggttctgtccccgttctcacttgtgtcacctgcagagcaggacttaacaagggcccccgtgcacaggcgcctccaggcatgggaataccaggcccccaggagggtgggaggggcctcagaacccctctcaggggccgggcccagcccagctgacagtgaccagctctgctggtgggagtccgtgctccccggggctggccagagatgcaggactgagccccatctttcacccctgccaagcgagccccaggccctcttctcccggccagccggcctcctgtccttgcggcctgagtacactctgatcactgtctctgttccctgtctccctcaaccccgccttctcctgctcctggcttctccggctctcagaggaagcccaggaggaaggtaagtggggtccaaggccccggcccccatgcccactccccagccttcccgccccacccaaagttgacctccaccccgcctctaaggattgctgtgtgcccctgtctaaccctctcctctctcccccggctctcctcagctgcagaagtccatgaggaaggtatgaggacacaggacttcttgtccccatgtggggcccggggcctggctggagcccatgtgggggtgggggagagggggagagggtggggaagccacgaggtaccagccagccaaggggcccccacatgtggccctaatgtaacccactaaccgcggccaatgcttgaccagagagagaatggggtctcgagggtgggcccccttccccacagccccccaggcagtagggccagggactccccaggcaggtgcaggctgggctgctggtcagcagggtgtccccaagcatggggcagaggggacacgtaggcccaccctagtcctccaccccagggtaggcagtccagagcccgtggtggcgtcgacccctgggcctggccaggacgcccgccacatcttgggatggcacagagtgaggggagagaaggcggctgggggcagaaccctgcagcctggcacagtcagctccctcgtgagcatgccctcgtcagccccccaggccccctcacagccttctgctatgagacccttgaggtgcacacaggctgggagcagatgggagggctggggtcccatgcccagatcagcaggcagagccatcactggtgcccagggctgccagcacccttggagggtggaaagaattccatcagggaaagaacgagtgggcccccagcgttgggatggcaggaagtgggggtcctggggacgccttccatggcccatccatggctctgcctcccagggctaccagcactgcctttgtgggcccttggtgccacccggccaggctacaacctcgcacgtgggccttggtgccccggccagaggcgcggacacccttctgggggcgccccaggacagacaggggatgggggcgagcaaaggaaggcccagccccagtactgagcctgctccaccaaggacaagagccacagctcccggccatcctctgagcctcagtttccccacctggggtgctcccagatgctgagagcagggtttggggacatgggactggggcggtggccgcgcctgggctaactctgaccgtgtcttgctcgctccccgcacgcaccccaccctcggcctcgagtggcgacgggcttttccattaacctcggacgcttctccattgacctctgacccgcggttttgcctcttgttccgtggcctccttggcccgtgaagttcatgaaccaggtacgtgcatgacttcgatgccacatgggcacgtgtggccatgtggggggtgcaggacccaagaaggaacaagaggggccgcgtaaccctgcacagcctggcctgctcgctccgccgcctcggccctgcccgccctcctctctgcgctgccaccactcacactggtcctctctctctcccgccctttctgccaccatgacgctgcttctgcagaggaagttcaagaaggtacgccggcgctcccccgcctccaggccagagtctccgtcctcccttctgtcctctcttgcttcctccctcttgcccaccccttgtgacgtttgccaccaacaactgaacccgttctggcctctgggctggggacagagtgaggaccctggcttgggaagggctggccggtacagtgcaggcttcctctgtgtctcccaggcagagaggattgattccatagcctggggacaatgaggcccttcctgggctgccaacaggaaggtgggaggtgggggtggccagccttgaggccgaggcagagcaggccttgggaggacggtgctggggtccactgggaccctctggatccaccagggtggggtgggaagagcgcaggagaggcctccaccctgccccagttagcaagccagaagcgggaaggtagggaggggtgaggtggaagggagggtggaggggcaagtggagtgaagcagaaaagcaggctgaggcccaaggtggggacgctggggacccggaacagccaggggccatgcgtgcaaaggcccagtcaggtcccagcatcccacccattgcctgggcctgagccagacacacccggagtgaggaggccccctgggtgggcctgccctccctggtagtggggccggctgtactgggtggaggtcagagagctgcacattcaagtcaggggccccagctggggagtgcttctcagctccccccgttcatgggccgtggggctgaggggctcctccctgccgggcctgagctcttgcgtgactcgagcctcggagaggcccctggacaagaagggacatgctgggagggggatgggactccagccatgcagggaggtgtccaggagatagcctgtggggatgacagggttgctgggccgctctggaaccagcactgaggccagcggacagacggacagcagggcagggtggggcaggagcagaggaggcagggccgcaggacagcttttgccgcttggctgtgtgctcgctccccgaaattgctcagcctcccacccgacctcgccctcctccctggccggccttcccacccggaggggctcctcagccacgcactgcgtccagcaaaaccactaagtcagggaggccagggcgggcagcccattcatcgtcctcaccgcgctgttccttccgggcccttggctggaacgctcaggatgccccaccgctcactcccggtgcacatgtgccccaaggcatccggaacgggtgacctcaggcccacctgcaaaaccaagagcgctggcgggctctctgtggtgtgcagggggctcccaggcaaccgaggtatctgccagcgaggaggactcaaggaccagtgcaccccaggccaggcactggcaaggcaggacccccacccccgggcccaggcctgctggccttagccaagtgcaggggacagcgctgggtcagacttggagggccgagggcatcgtgtgtcaacggccttgctgccacctaaggcccagagcagggactgaagggacaggatgggcgggtgccactaggccagcggcagacccccctcctgggccccagctgggccaggccagccaggtccaccccagggtctaggagcagagtgtatcctaaaggaagccaccccttattagggtggccagggcaggccaggcagaccccagaggtggccagggagaggtagcaggggggtcccagaggggcccagtctcaggacagcagccatgtggcagtcagagggcaagccccagggaggtcagggatgagtgcgcctgggctcctggcctgtgggtgggggctgtggtggacattccggactcaggcgggggctcctggggctgagaccagcaaggagttagacatcacgttgccggcagaggctcctgaggcctgagggctgtagtcattccatgaactgctgggttccacccagtaacacagcctttacaggcaggggtcaggctccgggaagcacgaagcaaaggggctgcacccaccccggctgcaacgccctcttggtggagagggtctcagatgccaaggttggccctgccagacccaagaggacagaccggggggacagatgagacccagtgcccttagccccccaccttgccccgcgaggtccccgtgtccctcctattctccactaggtcttccaggcaggagctccactgggcacccagccccttccaccccctccccaggcattgattcaccggccccagcttggggcacttgtagggccccgcaggcacaccctggagaagagagtgtccgagtgagaggggtgggccccttgcccgccacaggccccttgcccactgctcccccgcagccgcactggcttttctcttgcatgtgtgcttgtgccttttgccacctggaagacaccgcagaggaggacgcggaaggtaagggcccgtccctgccgccggaggtgcaggaccctggctctagccgacgcgagggaaagaggacaggctggggtctctcgctgccctgcctcctcctccctctgtcctctttctcttcccctggcacgggggcctcggagggccaggccttgctgctccgcacggtgccgctggggtcgagctgccagggcctcgcgggtgccaccgctccaagtttctgccacacagcggagggggagtaagcgggaccagccagcagtgccagagcccgggccgggcacgcccccctcccctttctcccaagcccctttcctcccaatcttcttcccgagcccctgtcctctttgctccgtctcctcccttcccagccttcaaggacgcggcctgtctcgctcctatttcttccctacctcttcctcacccttcctcctggccccaggccctgagctcttcccctccaaccctgccaggggcttttgcaggcctagagcagaaacaggaccctcttgtttctgggggttgggggtactcccagctgaaaaggacggtggccttcagtgaaggggaacccagggccgcaggccgcccagtctcacccaggctgtctctctccctctccccacgctggtgtccctctccctacgctggtgctgtgtggaccagaggagaaaccgagacccaagtgagtgtggggtcctggcaggcccgctgctgagtgtgttctggggtgggggtggtcaagtgagtgtggggtcctggcaggcccagtgccgagtgtgttctggggtggcggtggccaagtgagtgtggggtcctggcaggcccagcgcctcgtgtgttccgtggtggaggcggaggagagggccagggccagatgcctggagcctgcattcggagggacgctcagagcgcagggtgggagggatgagggtcacctgggagatgggcttgggaggcccagcagggtgtgattttgcccagggtcatccagtgcagacaaggagggcttcctgtaggaggaggctgcagacgaggaaggagggaggagaggtgggtgggagagagttgaggaaggaaggcggggcagctggtgcagggagtctggccaccgcaacaccccacggccttcgggggaccacaccaagccccgccatacttctaggactcccagagtcctagattgaaaagcgacaggaaagtgagtccggaagtggagaaaggtgggggactcagcccagaaacccacttcagaatgacaccttgaccgtgtccagaagagctcactgtgcaggggcccctgctcccctttggggcagaattcagaggagcttgtcctcatcgcacctgcttgtgagcacttcgtgggttggtttttttaatgcagctcttctgacttttctgcttttgatcggtattcaccagccacagcactcgctacgtgattcacccttttatctctcgagtgctcttgcctgtgtgttgctctgtgcgaagtggaatcttagagcatcttgacacacactcactgttggctcccacttggggagcattgcagattctcagaagagtgagaacatctgaagggtacagccggcgtattcccaccctttgcactgtatttttcagtgattttaagtacagtaatgctggatcatgagatattttctcattttagaaaaattgtttgtgttttcattatgaaaataagacacctcatgaaagaaaatttggaaaatatataaaagtcaaatgaagaaaaaacgtcatctataattctcccacccagccagccagactgtggaaaagagcagaaagaaataaaaagccttatttcttccttttttccatgcatagcgcttggaaaaaaaagatttaaagtcggccttgtttttcaaacatcataccgtctctacggccttgaattctgctttttttaaaatttagcactattcataagtatttttccatgtttttacacagtcttcttaaatattttgaatggccacataatattccatcaattggacaaaccataattttcctaaccattcccctattgcaggctttccccaatattttactatcataaataacgctggttggaaagcgttttccatctttagggttatttccgtaggccacattcccagaactggaattactgggtcaaagagtatgaatgttcttaaggctttgacatccactgccaaattgctttccacaagggcctggccaacgccgtctcctacgtgggatgtgagcgggtctgtgtcccacaccctcctcacccagggacaggaacgtgcttttacattgcagcctctgatggatgagaaacggcacctcatgattctttggctttgcgccctaacagtcactcggggccagcgtttccctgagtttgggatgggtcgtctcttctctgagaactcgtagctacggccattgctcatttgtctcctggtggaggaatctctgtgttttcttagtcatcagtttgcataaggatataagtcttctctgtatttgctgaaaattttttttagtcttttttttttgcctttccattttccgttttttttttttttttcacatacatacgtttttcatttgcgtggtgtcatctggccttctttcccttagaggcaccttctggtgctcctgagcttaggaaaccctttcctgctccagtttctgattgatatttagttccactttcttctatggtttgttggaaaaaattgttgttgttttaactctttgctgcatctggaatgtattggtgagaggaggggactgcacacccagccggagagggggcctcatttccccttcagattgctttcttcccagccccctctcctccttcctttgggcccccagagagaaagatgaaagaggggctggggaaaggcacaggctcgcagcagccattcctgcccagggaggccaccgccacccacagtggccatcgcttctcacccgacatggctgcatttgtttatctgtttgaggaggaaacagaggtgccctccctggtagctggggtgcagtgacattgcaatggccagaagccaaaaggcagacggtggcgctggaagcggaagccttcttgaggggctcaagccactctcaggatggtgggctacaaacctcataagaataaagctggggcaaacgtgtcactaggcgggcatgcttggctgggggccagagcaggagggcaccagggttggcaggggccagcggggaaagcgccaggctgaccctctggggtgggtctccgggtctctgctcacgggcctctctgtctcctcttcagactcactgctcctaagatcccagaaggggagaaagtggacttcgatgtaagtttacaggactctggttaacatgtccacggtttccccacaccccagcttttgggctctaggcctcagaaggtcacttcctcccaagtagccagagccggggcctcctgggtctgggcaattctaccatagcttattcctgggccagaggaaacccctctaagaataagcatctctcttcccttctcctccatctatccttctatccatccatccacccacccacgtaagctcctacccattcacctatccattcatacacccacccacacacccatccactcaaccatctatccatccattcatccacccaaccacccacctacccatccatccatccatccatccatccatcctgccttacttccatccatccaaccagccacgtatccactcacccattcatccatccatccacccacccaaccacccattcatacactcacctacctatccactcactcatctctccactcacctactcgctcacccacccatccacccatccatccatccattcataccactcattcatctactcatccatccatcgatccatctatcatccactcactcacataaccatccactcatccaccctcccacccacccacccattcacccattcatcctcccatccacccacccacccactcacccaccatccacgcatcctctaccattaatccacataatcattcctccacccatctacctatccatccattcatccatccatccatttctccaatcatccatctatccacccagtcatctgtctccatcctctctcactcatccacccatccatcagctcatctgttcacatgcctacctatgtatccaacaatttctctcactctgcagtcttctctctgccaggcccatgcagggcatctctgaggatgatgacagagccaagtcagggccagtccatcctaaggatgctgaggaccttatggctgggcaccatccctgctgtgtggctcaggaatcaggccaccctcggcccctatgaggatagcagccatggcaatgtggagaaggcaaaacattccttgccacttgccattttcatggtggccaagggagtcagggcttctctgctggggcaaaggaagggacctcttgctgcaaggcaggccaggcagggcagaggttggagagaggggtggggctcacacccactgcccctgcccacaggacatccagaagaagcgtcagaacaaagacctaatggagctccaggccctcatcgacagccactttgaagcccggaagaaggaggaggaggagctggtcgctctcaaagagagaatcgtgagtggggcagttcaggttgcagcaggggctggtggactccctcggaggagccggggacagggctgagcagacccccttctctggctgcaggagaagcgccgtgcagagagagcggagcagcagaggattcgtgcagagaaggagagggagcgccagaacagactggcggtgagggcaccatccgcactgctgcctcatcagagaatgagccccaggcccagagaaatgcagggggctgaggccttccttctcccggggttcccattgtcattggccaatgatcagaaccactggctaaggccccggcgccctgcagaaccccttgccagaaaacaaatcctggccaagacctggagcttccttccagatagttctaagcccagggtgggcccttccagacagctctaagcccagggtgggtccctaaagcctgcccagaaagcatagccctctctccatccctgagcatcttgggaatggggtctccacaggaggaaaaggccagaagggaggaggaggatgccaagaggagggcagaggacgacctgaagaagaagaaagctctgtcttccatgggagccaactacagcagctacctggccaaggtgtgtgccgctgctgggagcacggtggtagccttcagtgtgggctacgccctgtgccctcctgagaccaggcccctctctttgggcctgtccgctgcaggctgaccagaagagaggcaagaagcagacagcccgggaaatgaagaagaagattctggctgagagacgcaagccgctcaacatcgatcaccttggtgaagacaaactgaggtgaggggtgggtgttgtggggctcagccccacggggtggcccctgcaggagctgccgactgctcctcaggctgccaaggaccgtgctccccagtggctgcaggaggactccaggggcctggccctgcctttggggcttattcaacgaagcctcaccacttcctctgccccagggacaaggccaaggagctctgggagaccctgcaccagctggagattgacaagttcgagtttggggagaagctgaaacgccagaaatatgacgtgagtcccggcacctccggccctggggccctagcggctttcacccaccagcagagcagccatctccctgcgtccctaccaaactctggacctgcccaccccagggacctggaccctgagaggcccaaacaggctgttgccacggacccctggctgaggctgctttcctgctggggactgtggccagagcccgtcctcctggctggccatgcagcgccctgagcgatgaacctggcccctttgggcggccttggttacccctgccaaaaggactgtcgtggcagagcagccatggccaagtggactcagggttcattttcggaacccctttaagcttatagaaagtccccatcatcacccagctcggccccggggcaccgagtccgtctggtgtggggcgtcctttcgacagagcctcctccacaaacccagactctggcttccaccagggccccggacacctgcttcctcagggcagacagagaggggtgacacactgcaccctgtggctgggaaaaggggcctgggactgtgcccgtctgggacggagcagagccaccatcccatgcaggcactatcaccgcaggcaaagctgggactggggaaggcagcctgcccgggcggcctcagggactggggtacaatgtgggagctagggtggaagccaagctgcttcccaccctcccaaacacccgtttgggctccaggggcgaggggtgaggggcgcagccatgggtgatccacgtgctcggggcaaatgcagacactccagcatcaccatcagggccacgatgtccaccctccagcaccgccagaggccccaggggagggcggctgtgcccacggggcttgtgctctacccaggtgcagcaggtgtggggcgaccagtccaagccagccgggcaaatccgagctccttctcgggggttctgggcaggccacctgttccacctgagcttccacgagctcccctccgacagaggcagggcgattacactccctcccagagctgtccccagggggtccaggcatgagggacagccctgacctcacccttggggctctcccagaggggctggccctgagacgggcttcacggcacaggacccaggtccttcccatgctgtgttcccagagctgaatcagggacccactggctttggatagatgcggccacagcgggcccccaggggctccagagcctggagggccatcaccaggccaagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttgcacggtgaggtgaacctctcgcatggcaaaaacctggatcgctcaggatgctggcggcagggggcctggagccttcctcctgcccccgctctcccctcgtgcctgcagccgggggcttcccagtggccgctgccctgttggcaagcgaggaagggcccccaccttcccaggagctccgcctcaagccagcagcggccacagagtgcccctgggcacaggcacgagggcgggagcggctggcccaggagcagcagggccgttcggagctctgagctcagcggctgaagggagctggagctgagaaggaggggtccgcaggcctcacctgcaacccctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaacgagactaacccggccaggccacccaggccagcatgcgcaggcctgtggccagggacccggagcctcctccctctcctgcacgcaggggagccctggggggtggcagagtcaggaggagggatcccaatggggcttgcctgtcacgccctcgccccgagtctggcactggctgcagggagagggcagccaggggacccctagaaggggctactcggggggcctttggtgtggccaacctgggccccagggtatcccgccagtgtcccaccctccaaggggacctaggacagggaattaagcagtcagggcttcatcaccagcccctctgtgacgctgggcaaaatcatggactcctcaggatggtgaaacctcatccataaaatcgtgtccctgggggctgtgggatcccttgacacagctactcgaccacctgcatggggctgcacccagggtgcccccggcgatgccacgctggggatcctgtcatggagcccagctgcacagccagtgccatttccccaaggatcgcagtgtttgggggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctcccggctcgtggccacatgaagacctcagacaaatggggcaggctcctgggcccctcagaggccaccgtctggaggggcatgagctctttcaaggccaagcgtctaggattatatcattatctgctaagacagtcttccccagctcaggggtctgtctgcagtggtacctcaggcaaagaaaggaggacagagggagggtgccccgggctcacgtgccagccccctaaccacactaacgacctaggcccgccaggcacaggtgagtgggcactgcccggactgaagctgggtgtgggccgcaagcttgggccgggcctgtgccctgagagcagcctggggtcgggctgagagtccgcccagggtgggggaccaggaggggcatggccagaggccctgaccctgaaggatcacttgcttcccatttgcagcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccctt

SEQ ID NO: 26 - DNA, 29257 bp, Artificial Sequence
  Based on Homo sapiens sequence
aaggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacggtgagccccggggatggggcgggaggggaaggaccgacggacaagcaggcggacagacagaagccggaactgggccgcttgcgctttcatcttacactttgcagccggggaaactgaggctcaaagataacagggcgttggcagaggcctggcccctgagacgggaattggtaattagtgtggtttactgctattcctctacagaggagagagattagggtcgagtgaaaacagatacaggctttgtgggggtgggggtgggggtcaggcggaccagggatagaagcccagcagccgtgtgactctgggcaagttactcgaccattctgagcttcagatgcgtgtctggaaaatgggggtcctagctgccttatagagtgcttgtgaggatgagagattcaaagcacctggtgaggaagatgcccaaggcaacacagctggtgagcaggggaggcaggagaacccagccttgggctcaggcctttcccagcgcgacgtgagatccacactgggcgcctctacctgcacgggctctgaaaaaccgctgcctccaggccgcaaggccgctttctcagagctgatagcattgattagagcttgtccgatgagtttgcctgcacttctgttgagagtggagaggatgagtgagcttgggcaagccttcacgctctgcaccttttcatctgcaaaatggggctaaggcgtattctccaataacataaagaatggagaactgctgtctatgcataaagaatggtaactgcttgttacctcgtaaacgctcttaagtggtaacctaaaataaataaataaataaataaataaataaataaataaataaataaggccaggcgcagtggctcacgcctgtaatcccagcatcttaggaggccgaggtgggcagatcacttgaggtcaggagttcgagaccagcctggccaacatagcgaaaccctttctctactaaaaatacaaaaaatagctgggcatgatggcggacgcctgtaatcccaactgctggggaggctgaggcacgagaatcgcttgaatccgggaggcagaggttgcagtgagccgagactgcgccattgcactccagcccgggcaacagagcgagactccatctcaacacaaaacaaaacaacaaacaaaaaagaaacaacaacgaaaatagtggctttaacattctgatgtaagactccagaaactcacccaaaaaatggccggcgtccactagagggatcccttgcgccaggtcgcctgggtgaacctggtggttgcctgagtgggtggtttgctagggaaggggttgttccgccgggcctgttccccgccccttactgggctggattcctgggcacttttctgtttgttctgctttgctccacctcctgcctcttcccatcttcctccaagccctgtgaatgaagtgggactcggcctggaaaccgtgctgcagagagaagggttttgccccaggtatttatgataagactaggtggagaatccgggcttcctgaaacttgctccactgtgttccccacagcccccttccatgtctctgcactagcagactccctgaaacaggtcacgtgtatcacccaggagagacacaggctgcagcagtggccggaggctgggcatcggctgctgttttgagacattattttgtgtcaggcacaaagttacaaacaaggcacttttacataccttctttatttttcagtccctccaacaacctggtagttggtagtatctccctttgttaggtgtggaaaagtaggtaatattaccatcattccccctttacaggtgaggaacaggctcagagaggtaatgtccactttccccagagccggactgcttgagatctaacctcagctctgccctgcagcacctctgagttttaatttcctcaaagtgctgccaccccttgtcatatggacattgttatccactcagtgtactttagaatccagaatagacctgacgctgccacagacctttcatgtttcttattctcagttttcccatctgtaaaatgaggggcaggaatccatgctcatgtggctgcagggagttggttgaatgagatcataactggaaggttgggggagcaccatacacactaattctcagcttatccttcctgagcctttgggctcttatctcagttatttgggctcttatcttggcttattgtctgggacccagacaatgactttctctttattggctcccagttaagcacctcgaggggtgggtgatcaaggtaagaaaattccctaaacttgctaatttctctcctcttccttctgtccagcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtagaggatgaagggtgtacgtctttgggtagatcggtgtcaactacctgcctggtagaggggtgacaagcaacacctcactttacagtttacaaggtcctttcagtcaagtttcaggtacagcaagcacctgaatgacagccgttctttcagtttcatcttccgtgaatgaccagacattacctgtgtatcagtcagctctcgctgtgtaaccaccttcaaatttagtggccgtcaacaacaatcatttatttagctaataattccacagttggcaatgggcaaagttcagctgggcagttcttctggtcttggctgggttccctcctatgcccactgaaagctgagtgggagctctcgctgggtatatgagggagcgactggctgtcagctggaacatcttggctttcctccctatggccttttgtcctccagtaggctagtccaggctattctcatggtattctcatggcaatggcaggggctcagaagacaagagtggaagcacaccaggcctcttgagaactaaatgcagaactggaaccatcacttccactacgttttttttttttaattgagatgcagtcttactctgttgcctaggctggagtacagtggcatgatctcagcttactgcaacttcctgggttcaagcctcctgagttcaaacgattctcctgcctcagcctcccgagtagctggaattacaggtgcgagccaccatgcctggataatttttgtatgtttagtggagacagggtgggtttcactgtgttggccaggctggtctcgaactcctgacctcccaaaatgctgggattacagccatgagccaccgcacctggcctctttcactacattctattgaccaaagcaagtcacaagaccagcccacattcagagtgagaggggagtagaaattataggatgaagggtgtggctacaggaaggccattaattggggccatcaaggcaattaagttattgaatcttgtttttaagattgtcttacattagatgtaagttccatcagtgatcttgttcttagtcattattgtatcccaatacttagaataagatgtgaaacatattaggtgctcaataaatatatgttgagccagtggaggtatgtcatttgagaaggattctgattatttctctgactttttatatgaggatgttgaggatcagcggccatatagcaggtcagtatgtctggaacagagggcttaaacctgggtgttctgtctctagattttataaggatagttgatcagttaccccgtagcctttggagtgtctgctattctagggaggatggggacagtttttgtagcctatgtgtcagaacttttttttttttttttttttgagacggagtctcactctgttgcccaggctggagtgcagtggcgcgatctcagctcactgcaacctcctcctcccaggttcacgccattctcctgcctcagcctcctgagtagctgggactacaggtgcccgccaccacgcccagctaattttttttgtatttttagtagagacggggtttcaccgtgttagccaggatggtctcgatctcctgaccttgtgatccgcccgcctcagtctcccaaagtgctgggattacaggcgtgagccactgcacctggcatgtcagaacttttatcaagtgctactgtgtgccaagcataatccttaagttctcaacgagggctctcaaattcccagtcaataagaggctatccctgtggctcagaggagcaggtagacttgaggagatgtagtaatgcactaagggttatctgtgacagagagacggggctgtttcctgtctttgaggatcaaaggaagaaagactcttaactgtgtattaagttcttcacaataataatggcagatttatcatgtactttctgtgtgttaggttttctgcatacatgtatactccttaaaagggtacctggcatactgttaagcttctaagtgataactgtaacaatcaaagaattacttctgttggctgaccttggacaagtcatttattctcattttccctctggggctcagaggttaagaaatgactgaaaggattctcttatgactggcatagataacaagggaagtatgtaatgcccttagcaggttcttgacccacagtggggacccagtcaacgtggttaaatccaagctgaggcttgagttgaaagtggaaggcccctgtttcaggatgagaggtggaggggtatgtgcaaggcatgggtttggaagcaagatctgttgtgcaacacccactggggagcctcaaatgccaagttgatatagttctgtggatagaagctactagagattgaagggatgtggtcagaattacattttagaaagagcatcacagtggtagtgtgcaagctaggctgggaggcagtgcttgtcatccaggcagaaaatgccactagctgagctgagcctgtagccacagggatgagtggagccacagtcaccttgaagtggggggttagtggtctttctgcgagttcaacaagagggatgggggctatgtgaactagaaggtctttccttgttctcaagttctgtcctgctggcctgagtcaggagggttacagaatgggaataggatattgtgcatctttaaaaaaattgaggcggggtgcagtggctcatgctcctaatcccagcactttgggaggcccaggtgggtggatcacctgaggtcaggagtccaggaccagcctagccaacatggtgaaactccatctctactaaaaatacaaaaaactagccaggcatggtggcatgcacctgtaatctcagctactcgggagtctgaggcaggagaatcgcttgaacctgggaggcgggggttgcagggagccaagattgtgccattgcactccagcctgggcaacaagagtgaaactctatctcaaaaaaaaaaaaaaaaaaaattgaaatgagtctgttgttgcagtaattcatgtattggcaaagtttaaacaatgtggaagggaagaaagtgaaaaacaagactccatttctttcagccctagtccccaaaagtaatatgaatacattttatgtgtctttttcaaaatttccaatgtgtagatgcctactttagcctgaatggattttttttttcacttaacaagactgtcaggccatgtaacctaccacattctcttcaactgtgcacatacagtagactggtgtacaattgaggctcccccttgatgaataccccggttgtttctagtttgctgatagaaacaaggatgcagatatgggggtttgaatctaacccttttgcccattgccttaggaagacaattaaaagccagtatgcagtatagatgaaacctgtgttcatttcgttctccctcttaaatctgttttttcttttctgtttttatttttttgacacagagtctcactctgtcacccaggatggagttcagtggtgcaatatcagctcaccgcaacctccgcctcctcggttcaagcaattcccctgcctcagcctcctgagtagctgggattacaggcacccaccaccacatctggctaattttttgtatttttaatagagacagggttgcaccatgttgtccaggctggtctcgaactcctgacctcaagtgatatgcccacctcggcctcccaaagtgctgggattacaggcatgagccactgcacccagccttccttaatccgttaacttgagtggtgacactctttgagcttccataccccatccctaacatgcaggattgccttttccaggcacagcaggcatgcagagactggtcgtgatcacctttgccattcctttctacctgaaccctctgtcagtactcttcctgtccttcctccctgtggcccaggtggcgtgtgacgagcatggctcccggggtttcggctttgtccattttgagacccatgaggccgcacagcaggccatcaacaccatgaatgggatgctgctgaatgaccgcaaagtgtgagtggctgggcccgagggaggggcggaggctgcagggacagaagcatggcaccaccgactaggaatcgatgctaccctcaagctgctaatgggcaccaggcacttgagcggcaggcagccctcctagaagtgtgagcccggagcagctgctcaacctctcagggactctttcctcacataaagatggagctgatgatctgcattagagtatggtaaaggaagtggtgattttaaaactctagagggactggctaatggtcatatcatcaatggactcagtgttttcatctgttttccagccttctcagtatggggtgtatgtgtgtgtgacagggtcttgctatgtagcccaggctggagtgcagtggcatgaacacagctcactgcagccttgacctccttggctcaagtaatcctcctgtctcagcctcctttgtagctgggaccacaggtgaccacatgccaccatacctggctaattttttgatttttttttttttttttgtagagatggggtctcactttgttgcccaggctggtcttgaactcttgggttcaagtgatcctcctgcctcagcctcctaaagtgttaaaatgctgggattacaggcatgagctactgcgcctgactttttctttaaaccttttgtgtttcatgagattttggcagaaagaaaagtaggcatatgctaagcctgccctcatcatactgttaacttcgatatcatccccactacacagatgggaaaactgagaggcagataatagagagaatctgcctctggctgttccctgcccagaattttgattttgttcatctgagaggccagctcacatggtcagggccatggagagaaggtggctttgagctgggggatgcactgagagtcattttgtccagggttactcagaggagggtccagtcaacctgtcaaacaaatcttggtgggcttttcccagttctcagaagaatgctcttcgttagctccaatttactcaagttcacctttgccactcagttttcttcaaattttggtgcctggtacaactttgtttgtgctaaacgtgctatagataccatcagaatttattattatttttttaatctgggatgctttcctagatgtgtttacatgaacttggaaatgaacttttaaaattaatcttgtgactgggtgtggtggctcacacctgtaaccccagcactttgtgaggcagaggtgggtgaatcatctgaggtcaggagtttgagactagcctggccaacatggtgaaactccatctctaccaaaaatacaagaattagccatgcgtggtggcacatacctgtaatcccagctacttggaaggctgagtgaagcaggagaatcgcttgaacccaggaggtggagcttgcagtgagctgagatggcaccactgtactccagcctgggcgatagagcgaaactcagtgtcaaaaacataataaataaaaataaaattaatcttgtatttaagtgattttagtcaatgccccccatagcaacactagcattgactgcgtctaattcacttacccctgcttccccagtgcacccaatacatgttaataagcaaagccccatgatgagaatttgagtcccaattttacagcaatgaactctgaggctcagagaggttaagtagcttgcccagggtcacacagctaggcaactgcagagcgaggattcaagcccttgtctgtctgactctcaggctcattcttctgtgctctcagctgcctggtatataatagtaattatgtgtgcatttgtcgcaagaatgaaatcttcttaaccttctgctggggacaagctctggaacataatataatatcttggctattggaggtagccgggccttggggatgttctaaggagtattgtcctgcccagtttcctgatgagggatatgtaagcctggagaagggcagcagttgagcaggagttggcatgggggtggctgatggctggtagctgtccacagccatgagccagtgtgtcatgtccacagctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttggtgggtgtgtccccaagggagcggggggatcactgtttttcctcttcccttccaaagtctggtagggaggaggggctctcctggggtttcctgaggacttcccagactcccctttgagccaggttggtcctttgcagggaaaatgctgagtgtgaaggtgatgagggacaacagcggccactcgcggtgctttggctttgtcaactttgagaagcatgaggaagcccagaaggtaggagcctccccatggctctgttctgcagcagggggaccgagctgggactaagaagagggtcccagctgcctgtggaggggaagaaagtccctccccggcctaagccaagagggtgggagagtcctgtgtgcaggcaaagcccttccttctgtggtcaaaggccaagggcttcattctttggtcacttctaagccctgatgtccgcagagctgaatatttaggtagggatgcagaagtcattattatataaaaatatttactcatgaactgaccacttaaatcagtttccaccgggtgtggtggtgtgcacctgtagtctcagcctacgtgataggctgaggcaggaggaccccttgagcccagtggtttgagtccagcctgggcaacatagcaagaccctgtctctaattttttaaaaactctccagatgtgatggctcatgcttgtaatcccagcacttggggaggctgggtgggaagactgcttgagttcagttcgagaccagctggacaaaacggcaagatgccatcttcacacacaaaaaggctctcacagttagcaaagaggattattttgtgccttgaaatccaactcaaagtaaggatgttgatgatgctgtcatgccattatgagagaattatgcttgctactttgttcaaattatccatgtgtagttgcagttagaacctaaatttttttaagttctttaagttcttttttcagtgtagttttaagttcagagcaacgtttagtggaagttatggaggttttctgtataccccattcccccaacacatgaacagcctctgccattatcaatgtcctgctcccaagggttacgtctgttacaagtgattcacttactttgacacatcattaacacacacagtcccaagtttacattaggatttacttttggtgtagagtctaggggtttggacaaatgcataatgacatgtatccactattatggtatcatgcagactactttcagtgccctaaacatcccctgtgctccatctgttcattcctccatgccccttaacccctggcaaccaatgatctttttgcttgctccatagttttgccttttctgggacagagactatgtcacctagactggcttctttcacttagtaatacgcatttaaaatatgggaatatataaatatttacattttattttatttttatttatttatttttgagacagagtctcactctgtcacccaggatggaatgcagtgacgtgatctcggctcattgcaacctccgcctcctgggttcaagtaattctcctgcctcaacctcccgagtagctgggactacaggcgcccgccaccatgcccggctaatttttgtgtttttagtagagaaggggtttcaccatgttggccaggctggtatcgaactcgtgacctcaagtgatccacccgccttggcctcccaaagtgctaggattacaggcgtgagccaccatgcccggccatatttacattgtaaatatgggaaaatttgcaaatctcaattttatttttatgtttattttattaagatggagtctgtctgtcgtccaggctgtagtgcagtggcgtgatctcagctcactgcaacctccacctcccagtttcaagggattctcccacctcagcctcctaagtagctgggattacaggcacctgccaccatgcctggctaatttttgtatttttagtagagatggggtttcaccaagttggccaggctggtttcgaactcctgacctcaagtgatccaaccgccttggcctcccaaagtgctgtaattaccaggtgtgagccactgtgcctggccatcaattttgtttcttaaaatacagccccagtccgaattttttttttttttttgagatggagtttcactcttgttgcccaggctggagtgcaatggcgtgatctcagctcaccgcaacctccacctcccaggttcaacgattctcctgcctcagcctcccgagtagctgggattacaggcatgtgcttccatgcctggctaattttgtatttttagtagagacggggtttctccatgttggtcaggctggtctcgaattcctgacctcagatgatccgtccccctcggccacccaaagtgctgggattacaggcatgagccaaagtgggtatacttaaatggcctttgtcctggtactgattattctcagctagtgtggccagcctggtttgcaggtggcccctctagatccagaagatgagcctgggccagggccacatctgagtggttaccaagcatgttccctcctcctttccccaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccaggtgaggtcaggcttcctggtggcagccacttctgtgtgagagcagctgtgtgtcgggggccctgagtggtgactgtttcttctagtgatcctacttctgggcacttggctcaaggcgggaattgaatgagcatgggatggcccccactgcctaatgtataacagtgagaaactgcgcacaacccaactgtccaaccatcataggggttagtaggggtgctggggaccttttggttagaataatccttcacgtgggactggttagcatcccacccagcccactcaatcccagttgcatcctctagtctcagacaaccaaagtaccccgcatattgccagatgcccctagaggaaatcctactcctggctgagaataatcaggccaaatatgttacatccaaaagttggaatgttggacagcctttgaattatgtggagttaataattaaagtgaatattgtggatcagtgcaatttaaaacttcattgggaagtgaacccctctaagattttatttatttacttattttttgagacagagtattgctcttgtcacccaggctggagtgcagtggcatgatcttggttcactgcaacctctcactcctgggttcaagaaagtctcagcctcccaagtagctgggattacaggtgcgtgccaccatgcccggcaaatttttgtatttttagtagagacagggtttcaccatgttgcccaggctggtcttgaactcctgaccttgtgatctgcccgcctcagcctcccaaagtgctgggattacaggtgtgagccactgcgcctggcctcatttttgtatttttaatagagatggagttcatcatattggtcaggctggtctcgaactcctgaccttagttgatctgcccgctttggcctcccaaagttatgggattacaggcatgagccaccacgcctggccccctctaagatttttcataaaagttctagatccttcatggagaggggcatataaatatacatatccacacaaaacacgcacacatactcagtagttctcagtgaggagcagttttgcctcctgggggacatttggcaatgtctagaattttcattgtcgtgtgggtggtggggtgctactgtcatccacagggtagaggccagggatgctggcaggcatcctacagtgcccaggacaatgccacagcaaggaactgtctggcacaaaatgtcactagatctgaggctgagaaacacatacatcctcttgtgtacatacagcgtgtccaggggctttcatacctgcagaacaaaatactcatcacataatctgcaagagcaggatgctatgctgtacaattgtgcggtctctgttctcttgtacattcatacactgttgtgtttgggaggtctggaaggagaaaagtcaaggtgctagaggcagctgtcactcaacagtgagatgcacagactctgaagttagtctgcctgggttgtcctgtctctgccacttagctactgtatgatctggggcaacttatttagcctctttgtgtttcagttttgtctgtaaaacaaggataaaagttttcttcacgcagggttgttgtgaggattaaaaatcaaaacgtggcctgtcgtggtggctcgtgcctgtaatcccagcactttgggaggccaaggtgggcagatcacctgaggtcaggagttcaagactggcctgaccaacatggagaaaggagaaacccgtctctactaaaaaatacaaagttagctgggtctggttgcacgtacctgtaatcccagctacttgggaggctgaggcaggagaatcacttgaacccgcgaggcagaggttgcactgagccgagattgcaccattgcactccagcctaggcaacaagagcaaaaatccatctcaaaaaaaaaaagtcttaaaaaaaaaatcaaaatgtatgggaaagcttagagtggcacctggcaccaacatgagtaagtgcccgaggttcctgggctggcaggggatggaggggcagctcacctgtgttagggttctggtcatgggccagccagggaggagctctgactcctgctgcccgacatccaccatctggagagcttggcttgggcatgctctgcacctcagcctgccacgggacctgggacatcctcgtgggccccatctgtgaaatggggaatagctgtggtgaggctgggaccagtgcagatgtgtgagaactgcaggggaatttgggatgtgggggctacagcttgcatgtgatgggcacgctgagggatgggggtacctgggtgctgagggagacggggagcaggaggctgggctggtggggctccccatgccccttgtacctgcgtcagttccctgatctccccaaggcagttggggcttggaggagaaggggacatccagcagtttcccttccatcccagggtgtgaacttgtatgtgaagaatctggacgactccattgatgacgacaaactgaggaaagagttctctccctatggagtaattaccagtgcgaaggtgaggactgggggcacctccgggggacagcgttcccctccatcctctcaccaccatccccccacaaccccacccctccaccctctcgcccagcagccttcagggggttggtgccggctaccccttctggggctctgctgaccccgttggagcttgtagccatctgcagccttgtctgggctggaggggaagagggtagaaatatagtcccagtcacacagctggacttggggctcactgtcaccttggcatttattgagtgcctactgtatgccagattccagaaattcatatcttagtatttccattgacttttgttgtctggcctctgccagtgacattaccctcctgggcctccgttttcccatctggaaagtgagagggctggacttcgtcattcttcatttgttcttccctatttctggagcaccaattgtgtgcccaaccctgttaggcccctgagatgtggcaactggcccatcagcagctctatgagctttagcagatgttgtcttatagataaggacactgggctcactggatggctttccgaccctggcttctcattacaaccccctgggcaattcttaaatacacacacctcagtcaggcatagaatgtggatccccggggtagggcctgggctttttattttttttttttaaagctcccagaggctgggcaatatggctcacgcctgtaatcccagcactttgggaggctgaggcaggcagatcatgaggtcaggagatcgagaccatcctcgctaacacggtgaaaccccatctctactaaaaatacaaaaaattagccgggcatgatggcacgtgcctatagtcccaggtattccggaggctgaggcaggagaatggcatgaacccaggaggcggagcttgcagtgagccaagatcgtgccactgcactccagcctgggcaacagcgagactctgtctcaaaaaaaaaaaaaaaaaaaagcgcccagatggtttttaagatgatgatccagtgtttcttcattctatacttaaatacctgctgttttaccaggctctgtgggaaacaggagcaaatcagatgtgatccttgctttcaagtagcttatagtctagtgaggaagtcagcccgtcactaactcaaatggattataagatgggggacagtatgggaggcaaagctacaggagttcagtggaacagaagggaaggctgcctggaagaagtggcagtagcagcagtgtttgacttggctgtgaggaggtagggagctggagtgggaatgaggaattttccaaagagatcagtgtgagtgacaggatggggggacccgcctgaatgatgtgatgttgggttctgaggaagtggtctagaagttctcttttggctactgagtccagttgtaaacatccttcagggagccttgtgtttggaggaaaaaaggttgtcttttaggttaagatccttttgaaaaatgcgagagaaggctgtggcacatgtaaattaggcatcagtaaatttgattacacatcataaaaagctataggtcctctttccaagcaaatgcatatacatttgatgtagaaacatggttgaaagctggaattttaaagttaatcaggtttaaatgtaaaccccagtcctaccattacctagctgtagaaactgaggcaagtggctttgcttttcggaccttgtttactcacctataaagtgggagcaacatttctcacctctccaggtgtcctaagaactactaaagaggctgcatgtacagcatctgcattcaataagtagtgaaatagtgattgtcgtaatgattcatcatacaccttgcatacagcttcaggagatggaccttcttgaggactccccgaacaaaggaaatgtgtaaatttggattgcttagagttaaggcacacctggggtgaccatctttttaacaggacaaacggtataaaatggggattataaatatatctattttttgtgtgtgtgatggagtctagctctgttgcccaggctagagtgcagtggcgccatctcggctcactacaacctccgcctcccgggttcaagtgattcttctccctcagcctcctgagtagctgggattacaggcacctgccaccatgcccagctaatttttgtatttttagtagagacggggtttcactgtgttggccgggctggtctcaaactcctgacctagtaatccgcccgcctcagcctcccaaagtgctgcaattacaagaatgagccaccacgcccagcctacatatatatatatattatacaattatttatttattttgagatagagtttccttcttgtcgcccaggctggagtgcaatggcgcgatcttggctcactacaacttctgcctcccaggttcaagcaattctcctgcctcagccttctgagtagctgggattacaggcgcccgccaccaagccctactaatgtttgtatttttagtaaagatgaggtttcaccatgttagccaggatggtcctgaactcttgacctcaggtgatctgcccgccttggcctcccaaagtgctgagattataggcgtgaaccactgtgcctggcctatgttatgcgattttatatattttggtttattattattttttattagatgcaggttcttattctgttgcccaggctggagggccatgatgtgatcatggcacgccacaacctcaacctcctgggctcaagtgatcctcccacctgagcctcctaagtagctgggaccacaggcatgtgccaccatgcccagctgatttaaaaaaaaatttttttttggtagaaattgggagtcttgctgtgttgtccaggcttgtcttgaactcctgggctcaagcagtcctcctacctcagcctcccaaagtgctgggattataggcatgagccactgcatctggcctgtattttgttttatataaaaataattatgaaaattaaaggaattaatggatataaatacttataccactatcaagttcatggtaagctctgcataagtgttagctttgctaaattttatcattattaactaccgactgccagaagttcttaacaatatatatatatttttttttttttgagatggagttttgctcttgttgcccaggctagagtgcaatggtgcaatcttagctcactgtaacctttgcctcctgggttcaagtgattctcctgcttcagcctcctgagtagctgggattacaggcgcctctcaccatgcccagctaattttttgtatttttagtagagatggggtgtcactattttggccaggctggtctcgaacttctgacctcaggtgatccacctgcctcagcctcccaaagtgctaggattacaggcgtgagccactgtgcccggccctttggctatctgatgaagcctgtggaacccttctaagaatattttttaaaaacttttttgagacagagtctcgctctatcacccaggctggaatgcagtggtgccatcacagctcactgcagcctccaactcctggcctcaagtgatctcctgtctcagcctcccaagtagctgagactataggagcaccactatgcctggataattattttttatattacccaggctggtctcaaacccctgggctcaagcaattcttccgcctctgcttcccaaaaataggcatgagccaccaaacctggccctaagaatatttttaaatgcataaaataagattcttaggtgtacaaaaaaatcatactgaaaaaatataatggtcaaaatactaaagtgaaagcagtatgtgcttcttttattatttttatttttatttttttgagacgaagtcccactctgtcgcccagactggagcgcagtggcatgatcttggctcactacaacctctgcctcccaggttcaagaacctgggttctgcctcaacctcctgggaagctgagattacaggcacccgccaccataaccagctaatttttgtatatttttagtagagatggggtttcaccatgttggccaggctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaggaaaaaaagaagattttaaaaataactctagtccttatgggctgtatgagccaggccggtgtcttcaccctaaaaaaaggttaaaaacccagggccaggtgtggtggctcctgcctgtaatccctgcaccttgggagacctaggtaggaggatctcttgagaccagcctgggcaacatagtgattgctgatctctacaaacttaaaaaaaaaaattagctgggtgtggtggcatgtacctatagccctaactacttgagaggctgaggcaggaggatccctggagcccgggagtttgaggctgcagtgagctatgatcataccactgcactccagcctggatgacagagtgagaccccatctctttaaaaaacaaacaaataaacaaaaagacaaaccctaaatgccatgtgggttggatcctggaagagaaaaagaatattaggggaaaaaagagtgaaattccagtgaagtctggagttcagttaatagcattgtagttaataggagctaatggtataaaatagttaatagcattgcaccagtgttaattttgtagttttgaaaaatgtaccatgttcacattgggggaaactgggtgaaagatatacagcaggccaggcatggtggctcacgcctgtaatcccagcactttgggaggctgaggcaggcagatcacttgaggtcaggagtttgagaccagcctggccaacatggtgaaaccctctctctactgaaaatacaaaaattagccaggtgtggtggcacacgcctgtagtcccatctacccaggaggctaaggcaggagaattgcttgaacccgggaggctgaggttgcagttagccgagatcgtgccactccactctagcctgagtgacagagtgaaactatgtctcaaaaaaaaaaaaaaagatatatagcaaccctctgtactgtttttgtaactttttctgtaaatctaaagttactccaaagtaaaaaggttattttaacaaaaaggctaagaacctcttccccaaattcctaaagaacttggcttggtacttagcagaggcgatagaagcttaccagaacaatgtgttgggttgagtcctggctaacgtatgaaccacaggctgagtgaccccagacaagtcactctttcgagtctctcttatcccggctgtaaagtgggagccgcgatgcctcccgcatcgggaggttgtacatgtgaggtgtgaagacatgtaaagtatctggcatgcagcaggcctcatagatgggggtgcgtgctgcatccctcaaacagctcagtaaacagggtgcacgctacatccctccatcactcctcagtaaatgggggtgcacgctacatccctccatcacagcttgctaaacgggggtgcacactacatccctcgaacacagcttagtaaacaggggtgcacgctacatccctccatcacagctttctcgcgggcctgcccagtgctgggcttagcccatggggaggagggaggcagcgcagccccaggagccttccttccccaccccagcagctcttgtcttgtcttgcttttaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccttccctcccttcccttcccttcccttccctccctccctccctccctccctcccttccttccttccttccttcgtggggtctccatgtcacccaggctggtgagcaatggcgtgatcatggctccttccttcttccctcccttcctcccttcctcccttccttcacggggtctccatgtcacccaggctggagagcaatggcatgatcatggctcactgcagccttgaattcctgggcttgagtgatcctcccactgtagcctcctgagtaggtgggactacaggtgtgtgccaccatgcccagctaatttttttgtttattttaaagaaggggtctcgccatgttgcccaggctggtctcaaactcctgggctcaagcaattctcctgccttggcctcccaaagtgctggcattacaggagtaagccaccgtcccccgccctacatttttttaaaaattaaatttttatttttttggagacagagtcttgctctgttgcccagaatggagtgcagtgacaccatcttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtaggtgagtgtgggtagggccaaggggaatgggggtggggcaaagttggcactaggagtcaggaccagcctccatggtgaccttgccatatgccctctcggtgagcaaagctgactttggagactgtagcgtggtagttagcttggcctccagttcctgggaccaactgactatgaggcccttgctgactactatatctgtcacctaatctttaaaatggggacaaaaatagtacccccattttattgtagagaatttaaatgtttttttttttctttttgaggcagaatttcattcttgttgcccaggctggagtgcaatggcatgatctctgctcactgcaacctccgcctcccaggttcaagcgattgtcctgcctcagcttcccaagtagctgggattgtaggcatgcgccaccatgcctgggtaattttgtgtttttagtagagacggggtttctccatgttggtcaggttggtcttgaactcctgatctcaggtgatccgcccacctcagcctcccaaagtgctgagattacaggcatgagccactgtgcccagccttaattttttttttttttttttttgagatcgagtcttgctctgtcgcccaggctggagagtaatggtgtgatctcggctcactgcaacctctgcctccggggttctaagcgattctcctgcctcagcctcctgagtagctgggattacaggcatgcgccaccatacttggctaatttttgtatttttagtagggacagggtttcaccatgttggccaggctggtctcgaactcctgaccttaggtgatccaccagcctcggcctcccaaagtgctgggattacaggcatgagccaccatgcccggcttgttgttgaggatcaatgagatcatgcatgaaagggcttagcactgggcctaaagcctggtaagtattgcagtgactataaacaagggtgtaggttttggctgtacagcaagcacatctgttctttcattctgcaaatgttctcacatccacagtgtgctggggccccaagctcagcactggaggttctgcgtgaacgaggtatactcagtctctggccttaggttgctgccaggccctgacacccctgcttattcctttttattgtggtaaaatacacataacaaaatttaccacttaactatttttcagtgtacagatcaatggcattaagtatattcacactgttgtgcactgtcaccaccatccactctccagaactctgttcagcttgtagagccgaaattctgtacccatcaaaccataacttctcgttcctcctcccgctagcccttggcaactgccattctactttgtctctgtgaatttgactgttcttgcttggtacctcatgtaagtagaatcatagagtatttgtctttttgtggctagtttttttactttacatgtctcaggatgtatctatgttgtggcgtgtgtcagaatctccttattaaggctaaataatattccattgtatgtatagacctcatttttacttattcattcatctatcaatggacacttttctaccctttgggtattgtgaataatgctgctgtgaaaatggttgtgcaggctgggcgtgatggcttacgcctgtaatcccagcactttgggaggctgaggcaggtggatcatgaggtcaggagttcgaaaccagcctgaccaacatggtgaaaccctgtctctactaaaaatacaaaaattagccggacgtggtggcatgtgcttgtaatcccagctacttggtaggctgagacaagagaattgattgaacccaggagggggaggttgcagtgagccgagataacaccactgcactatagcctgggtgacagagcaagactctgtctcaggaaaaaaaaaaaaaagaaagaaaatgtttgtacaaatagctctttgaaaccctgctttcaattcttttgggtatatacccagaggtaaaattgatggatgatatggtaattctgtttaactgtttgagaaagccctatactgtttttctgtagtggctacatcattttacattcctaccaacagtgcacagtcttctaatttctttacattcttgtcaacgcttgttattttctgttttggtgttgttttgttttgttttgtttttggatagcagctatttgaactctgctttttttgttttgttttgttttgttttgcagccaacattggtactcagaccacaggacccagtggggtaggatgctgtacaccaggccggccgctcctgccgtgcaaatgttcctcagcagcacatagcacctatcgggtaaggccagcccagctgcctgctcttagcctgggctcctggccgcctggctcagaaccttagctaaggtgttgggccttggctttttttcttttcttggcttgtaaagtttcgtttattaatgtgtacaatcaataagagatcacccttactgcgagaaggggaaagagggccagcattacgttttatttacaatttgttttgcttcggttattaccaaaattaatttggatatccttagtatttgtgatgaacaccaaggaaaggtattctaagaatatgctgattattgaagggatgtacttaatcttcaaaacagaaaatacttactgtaatcaaagactgtgtatttatctccctcccctaaaaaaggcctaaaattcagcattatcatatcctgtgtagaatttcaatgtgtctcttttgaactatttcctgcaaaatgaatgagaacagtctttaaacagcaaaaatgtctatttttttttttggacagggtcttttttttgacagcacccaggttagagtgcagtggtgtgatcatagctcactgcagccttgaactcctaggctcaagtgatcctcccacctcagcctccaagtacaggcatgtgacaccatgcctggttaattttgtgtatttttttgtagtgacaggggtctcattatgttgccaaggctgatctcaaactcctggcctcaagcgatcctcccactttggccttccaaagttctaggattataggtgtgagccaccacacctggccaaaatgttttaaaattaccaagatgtgaaagggtgagaggtgtgccggggacatgtccataaatctacttgataaaaagtgctttatttggcacaaagttattggtaacacagggctttcctttatcaacgttcatcagggacctttataagttcgtagcactacaggaaacgtctaagctagaggcatgactttgtcttctaatccactttgcccttgttggggactctccaccccacctgatcatccagaccttgccctctgttcccctcctccagtgcctccctggccttctgctcacttgccagggtaagtattttgaggacatgcctgtccatggtgattaagggatgtgtccccggcaccatgcaggtccaggagccggctgtgcacatcccaggacaggagcccctgaccgcgtccatgctggctgcggcgcccctgcatgagcaaaagcagatgattggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggttgggagacagtccagatgtggggagatcaggggacaaagggaggagtaggggtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtttcccatagattctggattccttgtgcaattcatcttcacccctagtgtccatggcaggccctgataaaaatgccactaagtgaacacaagcttgttcctggttggcaggttctttactgcatggcccccgagacctccagaccctttactgaaggcccccattaccactgccccattgtttcctcagcttacttagggttttgccacattaccccttcccctcaccccgaaatttttttttttttccctgagatggagtcttgctctgctgccccggctggagtgcagtggcacgattttggctcactgcaacctccacctcccgggttcaagtgattctcctgcctcagccttctgagtagctgggcttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacaggggagcgtctctacccccttatccatgatgtccacacccagctggctggcaagatcacgggcatgctgctggagattgacaactcagagctgttgctcatgctggagtctccagaatccctccatgccaaggtaagcaggagcctgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaataggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctg

SEQ ID NO: 27 - DNA, 11121 bp, Artificial Sequence
  Based on Homo sapiens sequence
gggggcccctgggggcagagcgggtaggagctgggcaggaagagaggggagtccaggaaggaggtggagagaattggcgaagttccctgccacccccattttccagatgacgcgactgaggcccaaccagctttgtaggaggcggagtctccccagggtccctctctggctgtcctaggggagggggctcagggagccacgaggcccctccctgcctctccatctcccggcaagctcagaggggcggggagagagagccagaggaggaggagaactcaggcagctctgcagagggggccaggagctcgggtgtttggtacccccagccccaccgctgttgctgctcctgcagcggggacacaggtgaggacgccccgagagagagggggagggggaccaccactagcgctgtcctcatccttccctggtccagcccccacgccctaacccatcctgggatagtccccaggggtcccactggaccttgcccttcccaggcctccttccagggaccccgcaccctccccctgcctatgccaccttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctacccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttttctgctcttctccatgtccccaaggcccttctcagtccctcagaacattgcccaggcccctcctaggttctgtaaatgtcccccagactccttcccatctctttagttcttcctcctggttcctcttggcctctctagacacccccagtttccttgtttgggtggctcaaggtgtctccaagcccccaccatcctggagacagccacattctcctaaacgccaccctcactaagtctccctgggcttggggagtggcacgatggcggcaggcctggccacgtggctgccttttgctcgggcagcagcagtgggctggctgcccctggcccagcaacccctgcccccggcaccgggggtgaaggcatctcgaggagatgaggttctggtggtgaacgtgagcggacggcgctttgagacttggaagaatacgctggaccgctacccagacaccttgctgggcagctcggagaaggaattcttctacgatgctgactcaggcgagtacttcttcgatcgcgaccctgacatgttccgccatgtgctgaacttctaccgaacggggcggctgcattgcccacggcaggagtgcatccaggccttcgacgaagagctggctttctacggcctggttcccgagctagtcggtgactgctgccttgaagagtatcgggaccgaaagaaggagaatgccgagcgcctggcagaggatgaggaggcagagcaggccggggacggcccagccctgccagcaggcagctccctgcggcagcggctctggcgggccttcgagaatccacacacgagcaccgcagccctcgttttctactatgtgaccggcttcttcatcgccgtgtcggtcatcgccaatgtggtggagaccatcccatgccgcggctctgcacgcaggtcctcaagggagcagccctgtggcgaacgcttcccacaggcctttttctgcatggacacagcctgtgtactcatattcacaggtgaatacctcctgcggctgtttgccgcccccagccgttgccgcttcctgcggagtgtcatgagcctcatcgacgtggtggccatcctgccctactacattgggcttttggtgcccaagaacgacgatgtctctggcgcctttgtcaccctgcgtgtgttccgggtgtttcgcatcttcaagttctccaggcactcacagggcttgaggattctgggctacacactcaagagctgtgcctctgagctgggctttctcctcttttccctaaccatggccatcatcatctttgccactgtcatgttttatgctgagaagggcacaaacaagaccaactttacaagcatccctgcggccttctggtataccattgtcaccatgaccacgcttgggtgagtgtggactctgcgttgggggctgcccgattacactcaccctttctgtaaaattaggaagtttaaaggaatgatctctttctttctttctttttaaatggagtcttactctgtcgcccaggctggagtacagtggcaagatctcagctcactacaacctctgcttcctgggttcaagtgattctccagcctcagactcccaagtagctgggattacaggtacacgccaccatgcccagctaatttttgtatttttagtagagacggggtttcaccgcgttggccaggctggtctcaaactcctgacctcaggtgatccgcccgccttggccgcccaaagtgccgggattacaggtgtgagccaccgcgcctggcctctttctctttttgagcttcagtttgctcatctgtacaaactgagggagctggacttaattcttcagatccctcccagctctgacaatgccttgattttctaggtcaggagacttgggttcaaggattgtcttagctgctctctttctgttgatgtcgttttctcatggcctcagttttcccctctgtaaaatgggaaatgctgatcccttcatcatctagagaggattcaatgacatcatagttgtgaaagttctctgaatgtttctggtgcaggatacataggtgttggctttctagcacctttttctgttttggggacccatgtctcccaaccttctagaattgtctgctgtgtggggcactacttctgagcctttgtgattccttgatgtttcccagaacaagatgttttcagcatttttattattattatttttttgtcgatccctgcagaagaaacagagttgggataaaagtatcaaatggaatcatcgaactcatgagctttccaaagatactgtctagggcagatgctgtgatccttctctaagtttccatcactgggattgggtatacagttggtgctcagtatctgttgaaggaatgactgaatgaattgggtttgctcagtttcttcatagaggtacaaaaaaaagttgatttggggtttctaaagcgtagaaaccccaattctggttggaggtccaggatcagactgacaaacaaatactgagcgctgacagtgggctggaactgagtattttgatggcttttactctattcaagtcctcacaacaactctgtgatggtggatggctgcccatgtctcacagttgaggacacgctctgagatgacacatcacagagccagcaatggccaagttggaaagacttttgagcagagtcctgaatgcttaaaatgagtgaaaataccgaaataaggaacagccatcctagggcacagcctgagaaaaggcttagaggctgaagactgcagaggctgtgtttctctggaggagttctgattggttctgcggtcagaacaagagtatgcagtgtgatcttgggcgagtcagttacagaatctccctgatcttcaggggagctctctgtgaacaagttagtaaggttggctctgctctgtctctgtgggaggtgggtggcatggagaaaggcaggagggtttcaaggctcctccctgttttgtcatatgtggacagttttcaaggattcccctataggggaatgaaaaggggtcctacctagagcaggtaagacagaggcagccaaaaccaacaaaacactcctcccgggacttgaagcccttcggctggcctgtggtgctgggactctctccccaggaggctgtgttcactgcctgtgacttcctcatgctcccctctgcttggttttcatagatttctagctgactcaggtgcttggtatgtagcttggacaggggcagcagatggtaggggttgagggccaggcccatttctcacttggccacccagcattttacagagcaagaaactgagggactcagaaggtttgagtgcctggccagggtcacagagctagtccggattagatgggatggagtgggggactgaaaggtaggtgggcacttttcctgaccttggcctacctcccctcgctccagctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcaggtaaccgcactttccatccgagcacctcctactccccacaccccaagccagtctactttggggcttacccacctgaccttttatctcctctctctgcagaaggtgcgcttggcaaggatccgattggcaaagagtggtaccaccaatgccttcctgcagtacaagcagaatgggggccttgaggtgggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacggtgaggcctaatgtgaggtgatatagcagaatagagggggtccctctgcggccatgccagctctctcccttggatgggaggctcactacaaattgtggaaatcacacagagcttcctggaagaggctacaggagagccaagccttgaagaatgggcaagggaagggaagagggaacaatgtccagaaaggagaaaacagcctgagcaaaggcttgagggtgggatcagctcccatgggatgccccgtgaccctgcctcccttctgcccatagtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagaggtaagcagccctcctacctgctagccacacctggggaagctcagagcttagaccagtagctctgagatttcataactccaggcctagcaagtcaagctcgaacccaaacccctccatgctggaagcttgggcttatcttgtctggaactcattcttcatccattcttttttttttttttttgagacggagtctcactgtcacccaggctggagtgcaatggcgggatctcagctcgctgcagcctccacctcctgggttcaagcgattctcctgcctcagcctcacaagtagctggtattacaggcacacaccaccacgcccagctaattgttgtatttttagtagagatgaggttttgccatgttacccaggctagtctcgaactcctgacctcaagtgatccacctgcctcagcctcccagagtgctggaattacagacatgagccacctcgcctggcctcttcatccattctttcaccaaatatttattgagcacctactgtgtggcaggcacagttgtaggcaacttggatgtggcagtgaatgaacagacagaagcccctgtatcccagtcctctggaacttctattctagtgggataagacagttaataaacaaatacacagattatatagcatatcaacagctgtaaacaccaaggagaaaagtcagtcagggatgggggctagaaagcatagagcaggccgggcgcagtggctcatgcctattatcccaccactttgggaggccaaggcgagtggataacaggtcaggagttcgagaccagcctgactaacatggtgaaaccctgtttctattaaaaatataaaaaactagctgggtgtggtggcgcgcacctgtaatcccagctacttgggagactgaggcaggagaattgcctgaacccgggaggtggaggttccagtgaactgagatcacatcattgcactccagcttgggcaacaagagtgaaacgctgtctaaaaaaaaaaaaaaaaagcatacagcagggtggtgatgcagtttttttttttttttagacggagtcttgttgctaggctgcagtgcagtggcgcgatctcggcccactgcaacctccgcctcccgggttcaagcgattctcctgcctcagcctcccaagtagctgggactacaggcacgtgccaccatacccggctaatttttgtatttttagtagagacggggtttcaccatgttggccaggatggtatcgatctcctgacctcatgatccacctgccttggcctcctaaagtgctgggattacaggcgtgagccaccgcgcctggctgcattttttttttttttttttgagacgaagttttgctcttgttgcccaggctagagtgcagtggcgtgatctcggctcactgctgcaacctctgcctcccgggttcagacgattctcctgcctcagcctcctaagtggctgggattacaggtgtccgccaccatacccagctagttttttatatttttatttttttatgtttatttttatttatttatttatttttgagacagagtcctgctctgtcgcccagactggagtgcggtggcgcgatcttggctcactggaacctccgcctcccgggttcaagcaattctctgccttagcctcccaagtagctgagactacaggtgcgcgccaccacgcccagctaatttttgtatttttagtagagacagggtttcgccatgttggccaggctggtctcaatctcttgaccttgtgatctgcccactttgacctcccaaagtgctgggattacaggcatgagccaccacacccagccaattttttatatttttagtagagatggggttttaccatgttggccaggctggcctcaaactcctgaccttcaggtggtccacctgcctcggcctcccagagtgctgggattacaggtgtgagccaccactcttggctggtgatgcagttttagtagtgtggtcagagaaggctttactgaggtgacaactgagccaagacctgaaggaggcaaaggagtgggccatgcagataactagaggaagagctttctaagcagagtgaacagcctgtgcaaaggccttgaggcagatgtgggtccacattagagacatagcaaggaagctatcatgggtggaggagagtgagctgggggagactggtaagaggcaaactcagaaaggagcgagggtcccaccttagatcctactatggacagtttgtaaggacttggacactgttaggagtaaccatgagagatagcattttcatatgtatgcacattgtgttccagacactgctctgagcacttcgtatcatttttaatctcatttaatctccacagcaaccctatgaggtgggagatagtgttcgtcccatgctacagatgagagaagagagaggtttggagtggttaaagtgggaccaggatttgaacccaggactatctgactctagagtcctcactctttaccaccataattggggatgcaggagaagtacttaagtacttagcacagtgccagggacccagtaggtgctcaataaatgccatgattgctgtggcaagtattaattttttttttttttttgagacagagtctcactctgtcacccaggctggagtgcagtggtgcaatctcagctcactgcaagctccgcctcctgggttcacgccattctcctgcctcagcttcctgagtagctgggactacaggtgcctgccaccacgcctggctaattttttgtatttttagtagagatggggctttaccgcgttagccaggatggtctcaatctcctgatctcgtgatccgcccgcctcggcctcccaaagtgctgggattacaggcatgagccacagcacccggctgataactttttttctttttttttttttgttgagacagagtctcattccgtcacccaggctggagtgcagtggtgcaatctcagctcactgcaacctctgcctgccgggttcaagcaattctcccgcctcaacctcccgagtagctgggattacaggcatgcgccaccatgcccagctaattttttgtatttagtagagacggggtttcatcatgttggtcaggctggtctcgaactcttgacctcagatgatccactcacctcggcctcccaaagtgctgggattacaggcatgagccaccgcacccggcctaagataactttttaagagccttccatcttctccacccttgtccacagccgttccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgaggactgagagtatctcctggctctgtgggtttgggggctgggttgggcttgggggttgaaaacactctgatttcaatcccttttggctaggagaagggctggtatgggtcaaggtatgggagatggatggttggtgatgtattctggaagatggggatccaggagaaatgaaagagtgtggtttgaggagttcatctacagccagtgagacaggccagggggtcctgagacattcctccttggatatcatctgcgccagcttcctgattcacagatcgggaaactgagacccagagaaacacatagttagttagaggaggcttaaacccaggcttcctgacagcaaacaaccctgaatttaaccctaataaaagcatcactttgtttggtgaatttc

SEQ ID NO: 28 - DNA, 6992 bp, Artificial Sequence
  Based on Homo sapiens sequence
cttgaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgaggtgagcaagcctggtgggcgcgaccgaggctcccgggcggggccgacctggaatctcggtcgtttcccaggcatttaatcttttatgggaaagcctctgccgtcttccttgcccttgcaaattagttaatcattcatttatttagtccttcagttaacacatttttcctagaattgagcttcctgtcttgttctctgctatgtctcttgcccacatccaggacagcgctggcatgcaggtggcgagagtgggctaggttttgctggaaataccaaatagtgaaccaaaatagaagttaggggtcattttgtccctggccacagttggggatcgctaagcaatgatttaccccaaaacctgcctccccatttttttttttttttttttgagacggagttcactcttgttgcccaggctggagtgcaatggcacgatctcggctcaccgcaacctctgcctcccgggttcaagcgcttctcctgcctcagcctcccaagtagctgggattacaggcatgcaccaccatgcccagctaattttgtatttttagtagagacagggtttctccatattggtcaggctggtctggaactcccgacctcaggtgatccgcctacctcgtcctcccaaagtgctgggattacaggcttgagccaccgcacccggccacccctccccattcttatagtccctcccagaggtcacttacctcatcaccatacccccaatgactcgagttgccaatctccagttgcacttccacatcagttgatagagtgactggacactgtatgactcaacaaagagggcaaaacccacctccaatggcgtggcattgagagccctctgtgtctgtgccccacctgtttctgtctctttttttttttgagatggaggttcactcttgttgcccaggctggagtgcagtggcgcgatctcggctcactgcaacctccgcctcctgggttcaggcaattatcctgcctcagcctcccaagtagctgggattacaggcacccaccatcacgcccggctaaatttttgtatttttagtagaaacggggtttcaccatgtgggacaggctggtctcgaacttgtgacgtcaggtgatccacccacggcatgagccaccgtgcccagccctgtctctcttgtctcaggagctttgtgctgtggtgtgtggttctcccccaagctgttccttaccatcaaatgggaaacttaattaaagagcccaaccttggaaatcctgacttagtagactaaggtgaagccaggacaatttatttggtaacacattttcttgggtaattctgatgagtatccaatgacaagatccactgcagtagtcaagctgaatcactggctgttccagtggcacaccaggttctctcaccctttggtaattatttgtatatgctacttttacattatctacatttctttttttttttttttttttctgagaggtagcctcgttttgtcacccaggctggagtacagtggcttgatcttggctcactgcaacctccacctcctgggttcaagcaattctcctgcctcagcctcccgagtagctgggattacaggcatgcgccaccacgctcagctaatatttttgtatttttagtagagattgggtttcactatgttggtcaggctggtctcgaactcctgaacttaaatgatccacccgccccagcctcccaaagtgctggcattacagacagatgtaagccactgcacccagcctacgttttctacatctctttttttttttttttgagaccgtgtcttgctctgtcgcgcccaggctggagtggaatggcgcgatctcagctcactgcaagctccgcctcctgggttcacgccattctcctgcctcagcctcccgagtagctgggactacaggtgcccgccaccaagcccggctaattttttgtatttttagtagagacggggtttcactgtgttagccaggatggtctcaatctcctgaccttgtgatccgcccgcctcggcctccgaaagtgctgggattacaggcttgagccaccgtgcccggccacgttttctacatttcttagtccacttggtgaactcttcctccttcaggcctcatatgtacattttctgcctcttccagggttagagcgctgctctctagcagcatcttggacgtgtggcaagatctgcagtcgtggtttgtttccaggacctactcatttagactgtgagcacctttaggaaggcagaattgtctttgggccctagtgatacttgttgaaattgttagtttagtagaagagtacattgaaaggggaagaggcaggtggatcacctaaggtcaggaatttgagagcatcctggccaacatggtgaaattctgtctctactaaaagtacaaaacaattagctgggcgtggtggcacgtacctgtagtcccggctactagggaggctgaggcaggagaatcgcttgaacctgggaggtggaggttgcagtgagctgagatcacgctactgcactccagcctgggcaaaagagcaagatttcctctcaaaaaaaaaaaaaaaagaaaaggtggggagaaggaagaggtggcacctttgatctttgagcttttcaggcccctgggcctgggtctgacttgttgtaatgggttgtatgtgttctagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcaggtcagctgggcctcaggatggccagggcagcccagatgaggacttaccagaggtggggggattggatcaatataccaagagggaagagggggccagtctggcctgaactgtgacttccagggaagtgccttggagggactactgttccttccttcccaaggcctgtggggtgggcagcattctggctcattgctggttgggaggcttctgggcagtgagctggatccttgctgggtccttgtgtgtgtgtgtcagatgctgtgtgacatggctagaatatcggagctacgcctgattctgcggcagccatcaccactgtggctgtctttcacagtggaggagctgcagatctatcagcagggaccaaaggtaagtgactagctcagctgctggctggccctttccccagaaagcttctatgactgggaaagctaggtggtggggtgggtaatgggtgaagattgtgaatggggccttcatggaggttagctgggtgtgaatgctggaagctcacaatgagaggtgaggccatgtccccatatcccctgacctttggggccacctgctactttcagagctggagcctttaggtgctgggagacacttttgagcttgtgtttctgaggactccgtctgcacagcaggagaacttaggtagtctgactgcctctttaggtctctgtgggctccctaaacagggttttcccagtgtctgaggcccagcggcccttctctctgctcctaggaccttggaatctggtcccagagctgtccactttgtctcactcagggcagtacatctttgctttgcagagcccctccgtgacctttcccaagtggctctcccacccagtgccctgtgagcaacctgcactcctccgtgaggtaagccctcaccctaggtaagaaccatgtgtgaatggctctagtgtccaacacaggccaggtagaccccttcctgtaaaattctggggctgggcccagggcccttgggtgttatcttcctcctgggtattctgtgggatttgaggcatctctgttgtggggctacatcaggccctaacctcatgtttcataagccatctgagaatgttgttggtctcagctggagggcccctagcccaggttggcctctctggagcctgaagggcactgctggggagagacccatggccactgacccctccttctggagcagggtctcccagaccccagcagggtatcctccgaggtgcagcagatgtgggcactgacagagatgatccgggccagtcacacctccgcaaggatcggccgctttgatgtaagtaatcgcttccttctgcttggcttgctttgccctgagcagatcagacctgatggtcttttgtatttcaggtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagttcaagaccagcctgaccaacctggagaaaccccgtctctactaaaaatacaaaaaattagctgggcgtggtggtaggcacctgtaatcccagctacttgggaggctgaggcaggagaatctcttgaacccgggaagtggaggttgcggacctgagatcatgccattgcactccagcctgggcaagaagagcgaaactccatcttaaacaaacaaacaaaaaaaaaagaactgggacccttctgccatctgacatagcccaaagcacatctctatcctttctcccagttgcccctctccttttttgttgttttttttgaggttgagttttgctcttgttgcccaggctggagtgcaatagtgcaatcttggctaactgcaacctccgcctcccaggttcaagcaattctcctgcctcagtctcccgagtagctgggattacagtcatgcatcaccatgcctggctaattttgtatttgtagtagagatggggtttctccatgttggtcaggctggtctcaaacacctgacctcaggtgatctgcctgccttggccttccaaagtgctgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggtgggatagagggtgctgatcttggagg

SEQ ID NO: 29 - DNA, 64592 bp, Artificial Sequence
  Based on Homo sapiens sequence
acggaaacggtccggggctgagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggtgagtctcctggcggcctctccgacacacggaccgtgtgcactgcggctctgcctgtttgtctgtctctgtctgtctctctgtttaaaaagagaagataagaataataagactaagaataataagatctcttggctagagtcagggggcatctgtagccctggatgaggaagaagcggtgctgtgaggccgcagctccacctctgcccggtcttctcctcacttccgcagcacccccccccccgcaccccccgccttggcgtcactgcgctacaggccgcctgtaatttacatatgttttaacgctaacattgggaagcattgggcctttctgaagcctttttgtttcgttttgtttgaagctcccctccccccagtaatgagcctcagtttggtcctaagggctgggtcgccggatcgtagacccaaatccttgcaaaatgaacgactccctcccctcaaagaggagggagttgtgttgttgttttgttttgttttgtttttccgcccgttttcttttaacggccccgcagccctctgtgtggccttgttccctgtgaataattgcctcactgttcttcctgggggcttgcgtttgtgagactcaaggtgctagcctcttcactttccatttcccagacaggaaattaagctttcctctccattcgaactttttaaaaaaagcctgaggaggtatatgtgaaaattaaccccgtaaaatagcactttttttttttaattaaccacaacctttagttagcctagcagtagcgttttttaagggtggtcctggaaaaattactgtttggggtttgtttttaatgggggctacttttccctttctgagcctcagtttactgctctgttaaataaggggcgagtctggatgatctataccagacagtgatcgttagctctgtaatgtcttcaattgaaaagtgaagttatgaaactggctgtagttcaggctacctgctgtaggcagactaggttggaatagaagcagcgttggaacaggcgggaaatagccatcccaggaccacattcttgggggttatacttgatattaggcaattttggaacattcatttcacctcttagggactgtattgccagtttatttttttctttatggctttatctaaatgcttcaggaaaattttgccatatgtcatgattatcatgtctacaaagacagtttctcctttttgtaagtcacaggtggagaatgtctttggccatataactgatagaaaagtcattttaagccgtgtgagcggtttcaggaataaaagcatgtaaactcaggtcaaacagcctagaactagggacagagtgtgtgtgagatttcagttaattaagaagttgaagggttttttttacatttataaacggaaaggaattacattatattgaaataaatgtaaagatgtctggtagcatagaaacaggctaattctagcgctaattttgaagaagaaataatccaagaaatcgagtagaaattggatgaattcaattccttaatggaacttcagtaatgttaaataagaactgcatgttccttaaatgacttgattttgtgctgcctcaaaaactactgaaactcatattaagatttctaaggtatcagttttaattgaaaaacatattgtttatttttcaatttttaatcattaaggttcaaaataccctgaacctttgggtaacatgagggtttttttttttttcccgattaagtcagacagtttaaaaacctagtatctgagacgggaagctttttaaaagtgcatctctgaatcagaccactttagaaaattattttctaagttaggcaattttaaaaaatatttaagctaagcagaataattaaaaatggatagttaacgtatacagtttggaaaaatagatatgtcagggtatatacagatacatttagctaactcacagttttttgaaaatagatttctaaacccaactaaaaatacatttctaagaacgttaaaaaatgttttctaaatgtcataccattgaaaatgttaatatttatattagtctgaccatttaaaatctttctcagatcattgaaagcagtcatatcatttaaaatatccttatagtcaatccatactatctcaaaaataggttttgcagtctaacaaacatagtttgcctgaattcaaatttaaaaataaaacacagatttatatattttaattgtgttaaaaaatggcatgtcataaatttctgaagtatttagggttgaagtgttacatcttcactttgcttacaggtgattcgtaacaaaatctattctgcacacagtacggcgaaatgctaacaagactaaatagaggttatgattttttcaacttttctggaagttggaaaagctttataaacattttgaagcaaaagccatgtttaacacaatttgtaaaatctattgagtaactcttagcaatgcttttcactgcatatctagctcacaaaaaatttaaagccttgtttctgacttgtaaatttcaaagccatgtagcaaaccaaacaaaatcgtatctgtcaaattttgaatatggactaggtattaggtgacattaaggaattaattataatacattacatttgctaattttattagagatgcctactgaaatgtttagtggtgaaatgtcaaggcatcttacctaagtccttaaacccctccaaaaatagaggaagcaaataaggcaaattgttactcattgttaagtctagtgatgagtatgtgtgcgacattttaccattttgtaggcttttctgcatgtttgaaaatttttaaatagaaacttaaagtaagtatatttgttatagtaaagtaaaacagttaaaaagaggcaatttgtaaatacatgtctaacactcaggcaatttgaaaggaagaaattaaacctaagtttaacttaatttaaaaaataataacctggaattttaagtttccaattagaagaaaaagctgtagactttgatcttgatgcatttgataccaactaaaaatacacctaaaataacagactttttaaaaaaaaaattgtaatcctgaattttgacatcttatttcaggaaaaagctgcagaaattaattgcagagtagtgtgtatcatacacctcaaagcaaagcacacctaaagccatgccattcaaaaaatttaaacatgcattttttgcatcctagtttgagggaaaaaactagaatttggttgttgtagtggggttattgtgtgtccctgtgcgtgcatacagggttttgcagcattcaggcaaatatgtcaaataaacaggaatttaaggaggatacgcagtgaccagataaacacaaagcctcaagggccagaaggaacctaaaggtcatttggcctaatgtccccatttgtgataacccctcatgcctatcttatttggccatggtgtatgacaatgatggaaaatgccagcagctccatgatttttaccactaaaaagtctttgcctgttaatcccaactatttgtgtcctggggtcctgcttttagttctgttccttcgggtcttccttctgtctggtaaccctgcagccttgttacccagaattctttccaggcctagcattcccggctcagagtggttatgcttttttcctataaatgatgtttagtttttctgtatcctttttagatttcagcatccagaactgagcaaaattctacttttttgtgttcttagttgtattaaagttagtaaaactaattgtaaaaaaacagacaggtttgactttatgcactcctaacaaaatacagtcgtatttcccatgcattttactttggcctcagttttgagtgccccatcacgttcatgcctcagggcagcatgaaataaaggaaagagcactgagaattgaatctgagaattgaggcctaagtcctgttctgctgcaggctcagagtgtgtccttaggcaagcctttaatcttttcggacattttttgcctcatttgtaaactgaggggtttgggttaggtgatttccagcagccctatcgattcaacagtattttctcaagttctgttttaatacattgtttctcctgactttagctttaatttgaaaaggagaaattcatagtcaacagtgttgtagctgtcagtccaaggttactgacagaaatccttagaagtagccccagtactgtgcaaaagtaactttcacattattatgccagccaagtgcaggttttaaggtagcaactcattcaagcagcttggctttaggaaactgaaatggatttatgaagctaaacaattattcaaaacaaattgtaaagtcataaagaaatgaatgaaaggtagatattgagatgctcttctgatctgatgaaattctgtatggatttgtgtggtttccttcgatctccgggaatggatctaatataggggttggagctactttgttagtgtttactgcctaatctatactctgctttaaaataatgcataatctataattggaagctagcgttaattggtcttagattagtttgaaacataagcacattatttttaataaaatgtgtgctttaggaaaaaggaaattaaggattaactatggttataagaaacctgaggtccttattcaggcttgactacaatattagctaagatttatggagagtttactttgtgcctggctctgggctaagccctttccgtgtgtaagctcagctcatcttcacagtgctctatcaaataagtactattgtttttctcagatacagataaggaaacagattttagaggaggtaggaaactggcccagtgtcacccacctgatggctgggggctgtgattggaactctggcaaatctggcttcagagccccgtgctcacctcctgggccactctggtgttggctgcattttcagaacttgtgctgcagatcctggaaaatggaaggacctattgttttaaaacaattttttttcttgcaataggctagcatctttctttatctcactttatgaaccttacatagtcaattttaacttgcagattgaagattctaagttttagtacaagctgagtctgttggaaaattagttctctgtctttagaatccaagtatgaaatcattatatatttctctttagatctacttgcttttctgcttttaaagattccatgggagcagtgaggcttactttgagaataagggtactttgttggataaaagtgaagcaaacttttattttggcagtaacggaaataaagtaaatatcactatagcatagacctgtgtttccaactcattttgctcaacttttccagacttcctgagtaaacacagatgggtttccacttatttttcagttttatgtagaaagttctttagactataaattccacatgctacttggagttttcagtgtttgcttgattgcatgccattggaaggtcaaaaacctagatttagacattataaagatttagaaggtgatgatgtgtagtaacgtgttttcatttggctttattttggtctttcttgatggtaattctaaatgttttaattcaggtcttgactaaatttcctggtaatttggtggcagacagaattttgaaagccttctatttttaaatagcagaatggtggggagggtctttgaaaaggtgaccttaatttaatattcctgatgtggtggtagctgcctatcacaagtaattccctgaattgttaataaaattagagaggctggagggtggggtggaaagagacctgaacacctgggtctgtccccagtctgaccattaacaagctctgtggcttcaagcaatgcatttatacattttgaagcttagttttcttatttgtaagaaaagacttatttctagccctagaatcccatgattctgatttcacctcttatcaactaataattgtagaaatcagaagatcagggtgtgtgtgctcggttaataatccaagagcataggcacatgtgcagcagagattttaaccgaggtttgcaatagtacatcgttcaaagattaaatgccagggagccgctgcagaataggaagaagactgagatactcaagttagggattttgtcttgcatcatgttttattaataaaagattttaatgttctcttaatgttaagcttttaaaaaataaaaacattttttctttgtaaagtaaaaggtaattaaatcagctttccatttgatttattaatatcgtctagtactactattatggcagggtgtgtatagagttcttttttgctctcatagaaaattgtggaaggaatgaagaggatttgcagcttttcataatgtcatctaattgaatttttacgtggagtaaagtttgattacatttttattgctatcattgtttaataatattttgaccctgatagagcagcttcatttgcactatttttaaataagaaagttatgttttattttctaaatttactgctaaacataaaaaaacacaattgattattgaatttcaccactaattatttcagtgatcaatactgtacaaaaaaaagacctagttgtttagattatctgtcattagtaaatgtctgtccagaagatagagttccatgttgatctaaaaaagaacctttacttttcaattgaaacttaaccctctggtgtcatgcttctcccttccccctccccttaaaagaaaaaaattattcttaccttttgttttgtctcgtttgcttgcttttataagagccttatgaataactgtatgctttctagctaataataatacataccaagagatggtaagagtttttcttttattttgccacctgtgtctctctccgggaaagagtggtttctcagctctcttactaccagggatgaagccgtgtctgcgggatgtaatttgcagagaccttacatatgtggtcactcacatgttatctgaatacagctacagacaatttttgtgggtcatttattttttaattttgttgcatttgcaggtctgatttacatgttaaaatatacatttatttaacatgataaaattacattttagctctgctctcttattttattttcctgagggaaaatagaatgtggtattgtatgtgatatttggtgtttatgaaacagattaacagcatattttagtgaaaccaaagcaagtgtgttttatctgtttccagtgtattttaatatttacagtcattttttgcttgtttcctagctcattttcaaaacaaccacagtaaataaaaattaaagcatatattgatgtagcttaatttaaaaaaaaaaaaggagattttaaaatgccttgcttagtggatctttatatttagtcagcttaaaatctcagtgttttctcaactgaccatgccttgtctgtctgtctgtcccatgctgctttctttgtgctttccccaactggatgggactgatggggacaacatgtctcttcaggagctggacgaggtattgtgttttgaatatttttatatgttgggtaatttgagtttataaaatacctacttttcctgaagtctttgctcatatataaaatgctaacagcttatacatatttagcatttgttttgattactttataatttttttaacagtttaatatgtagaatttaatctattttcacaccatgtgaactgatgatttaaaaaaggctttgggaagatcgtttactagtcttgggaaagtgtcttaactttggaagcagtaaaggttgaacactttcttcaaggaagccagaatgttttgagaattaatgtctgtagcttcctgatttctgagaagtgagtcgtgcacttcctcaggtagacagtatagaaggccagcatgtctgtgaaggccctaaatgagaaggactgtagccacggcaactgtgggagggtcttccttgtcactcctgtctggaatgagatgacacccagtggatgcacctggagctattgtcacctgggcccagttctgcatctcctagctgggggtgcctttggcctttttattagctactagcatcttgcccagaaggtggagagaatatatattcaaagcactttattttagtagccggagtaaaagggttgagaaaaaatgagattaaaactgttgttaatgtttgtgtctattgtctgtttcagcattgaaggggtaagaatatttttcctgagtatagaccttttaagtagagtgatggagaggtgagggttgttcttgtttgttttcatttagaagtatgaatagtaaagtaggattaggaggatcactgtccttaaaaccagtggggtcctaactagtagattcagatctacctatatattctaaaaaccttaactagttgataatgacaacagactgagcacagcctaaatagccttcattgggaactggttaaatatattgtgtagcatctctgaccctctgtaacaggtaaatagtgaggcccatccatgagagctgcagtggaataagccccagacacatggcggagtggaaagacccagatgcagagcagcatggataatatgattcctgctccttttttttttttttttttttttttttcaggaaaaataactcatatttatgcttgtgtgtgcttaaaaaattcctgaaaagatacacaagaaactgttaacagtggatacaccccaagaaacatctgggatagaaaacttcctttctattgcaaacccttttcttagggtggatatatatttttaaaccatgtgcatgtatactttgccactaaaaacaattagttaaaaaaaaaaaacaccactcaacgggtagctgactgagccaggtgtcatggtcatgcctgtgtgggggtttcctttcccattcaggaacctcactgccagctccccgcctgggcacggggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccatttgaataatgttccaaggaggggcacataagtggtcataattacttcggggtctgctgtctgaaccgatttccagtctttcctacttcctttttcaggcagcaagttccagaaactggctactcactgcatgaacttggcaggcccttttgcttttcttatgtttcacctctaagggcttaaaagggagtcttcacgctctgtgatcagaggccctgcgtagagagcactatctcctccacgctcaccccagtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttcttgtcggatcactcagctggttgtgattgtgcgttcaggactctgaagtgccaggtactggcctaggagcagggggtgtggttggggacagtgtccagaggcttctttgaagctgacgcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttacccagggaagtgtctggccctctcctttgttctctgtctttaatctacttcctgtcttatgacaaagaaatctctgggagtttttaaactcaagaattattttaaaagtcacaagataacaaatgtcaagcccccaaaccacactgcctggaggactgcacatctgggagtgcctgggccgggccccagtgtccatgttggtgaaatagggagcggcgctcctctgaaggattgttcttgggactggcatgggccaggtcagtagcagtgctcagtacagtgctcacagaaggcagggagggacggattgctcccctcctttttcttcccctcagagtatgtatgttagttgagaaaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcgattctcctgcctcagcctcctgagtagctgggactacaggtgcgtgccaccatgcgtggctattttatttatttatttatttttgtattttttagtagagacggagttttgacatgttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttagaaaaatgtagtgctgacatcacttttttcttttatccacatgcttattcacttctccaacaactcggatttcttaagcctaattgtctattagcgaagtagtctgacttcatcatacaggctcccagagtttcacgtggaagtgtgagttgccagtctgttgattttcagtgtcccttctgggctttccaagtgttcattgccatagacagtccagaattatcggtattgttctcattaccaatgcgttacggctaaacttagttgatttttttagatggggaggaggtgtagctgacttttccaatctccacagaggctttgctatttctgtaatcttagtctacactaaatcagccttcagggaaaggcagggtttttaagagtaggagggccatagatttggaacagcaagatttataagagagaatgtgtatgttctttccatagatggagaacttgtccatactggctggtactctttaaatggacaaatgtcaacatttgaagtggatcaaaggcaaaagatacctttagtgagactggcaggaaagccattgggtgtgctgttttgaacatctgttggattttttctgcatttctctcaggaaggatggctctaggttagggtagcggaccccagtagttcttggagagaggaactacatatcaaagaggcaagaattcttaattctcttaagtacaatttttatttaaaaaatatggatttttttttttttacttcagaagcacaaatttatttatttatttatgtattgagatggagtctcgctctgtcttaataaaaggctggagcacattggcacgatcttggctcactgcaacttctgccttccgggttcaagtgattctcctgcctcagcttcccgagtagctgggattacaggtgcatgccaccatgcccggctaatttttgtattttcagtagagacggggtttcaccgtgctggctaggctggtcttgaactcccgacctcaggcaatccgcctgcctcagcctcccaaagtgctgggattaccggcgtgagccaccatggccagctgcacaaaccaacatcatatatttggagggggcaccatgttgaaattcagtaagggtaaggagagagaattagaaacctggccattttttaagatctgtatgaaataggatggcagcttgaaaattgatacatatgctggatcttcaacaataagaagacatgtttttaaatggaaagtgaggtttctgaaattaaaagggtgcttatgttgcacataaaatttgtttatgtccatatttgttcccatttcaaatagttgacgcttatcttcaacaattgttttcccttcccaaaacatactgtcttgttttttaatagtacatactgtgatacacattacaaatccatactgctaaaagaaatgacacatttcttctcaatagggtggtgtttctttattataatgaactatagctatagactgtatcataaaagagacaaattattcgctatttaaagttttcattcccaaagaatcagctgttctatcttactggcaaaactctgatacaatgtgtgggaaagctagtaccagctgagcaggctggcatccatgctgttcatgtaggaatctctaattagcaagcttccttaggacccttaacaaagagtgtgttctccccacttttgatttacatctaatttgaggggaacacatgcataaaatcaagtactgcttcaaagagttgtattcacttcaaccgacttttcatatgtggtttataatttgttgttttggataaaatgatactaatcccaatgcaggtaaatttagatagataccatctctctgtcttctttagtttaatgtgtatttgtaaacagtaaaaacagtacaaaataagatcatgagcttaaaaactctaaaatcactataaataattactgattgaaatgtgtaataataaaatatagtggattcgataataaactggtgtagtggaaattctaggacccatgaagaggtcctttagcaattttagattttactttgtataaacagctggagttcaagttctgttccagtccagcaatactgtagacagcacctgatgtatggctggcaggtgctgcgagctgggcctgtggtttgtccccctgctttttagtcagtgtgtcctccacagagttgtgtacctcttggtgactttggagcaggagtgttgaggaataaacaagtctgcctctgagtgcttggcacaggccctctctgtgcctgctctgtagagggtgaggtctgcgcctctctgtccacggatggtcagtaagagaggatgatctttactgacactaacgtcactcactggcggcctgtcctatagtgcctggtgtagttggtgggaaatgaatcaaactactgtgttttgttgttttaatctgatggcttgtcttgattcattttcttagcaaattgcagttatagtttatgggcctgtggagtgattggcacctttgagggtggaaggggtttctggagtcagccgacccaggtttcagtctgtcacataatggctctgtgaccttgggcaagcgacttaacttttctgagtttcaatttccatatttataggttagaataatagtttctaactcacctagtttttatgaggattaaaataatgtcaagaatgtaaaattcctattgatgaactcttgaaaccaaacagaaggtagtggtggtggagaattaccacttcacggcccgggagccccagacagtgcgggtttggatgacacaccatttgtttaagaaatgacactggccctgcagcatccgtgccacgcttgagcaccgttgggcttaatcacggctcctggacgtgctgggattagtgaatggggcctagtccttccagcgtggtcattgcctaagatgcgttccctgagtggacacgtgccccagagcacacagaaagcctgaagcagatggtggcagaaccactccagggcatgcagggaggttgatggtgaagataccaatttgcttttaagaattttactgtgaactctttaggatttagggcctattacttgaagtggtcttttattctaagtttttctttatatgatatttttcccccttcatctgtggattttaaaattttgtcttgttcctttattattagaaaagcaaataagtatttaatgaatgaaaaaataaatttagttaaatgcaaggaagagggaagaaaagcaatatgaatttttcacccaactctacagtgtgatttagaaaatttccaaagtattatctataaagggcttttatagattattttccattatattttgatcatcatttggatcttttgaaactggcatttaaaaattctgagctctggagggcacctcaaaatcttttcaacccattcactgcctgcaggcaagaaaacagcttaaccgtgccaaacccatgatttccctctgttttttgtgtgtgtgtgtgttttttttttttttttttttttgagacagagtttcgctcttgttgccctggctggagtgcaatggtacgatcatggctcactgcgaccttcgcctcttgggttcaagggattctcctgcctcagcctcccgagtagctgggattacaggcataagccaccatgcccagttaatttttgtatttttagtagagaacggttttcaccattttggccaggctactctcgaactcctgacctcagatgatctgcccgccttggcctcccaaagttctgggattacaggcgtgagccaccgcgcccagccgatttccctcccattcttaaaagctttctaccgcagtgtgttatatagttaaaataaacaggaaccatcgataccatttcaaaataaggggaaatgttccctgtggacatttaactgaagaaaagaaatgacagtgtaagattgcattgagatcttaaggattgcttttgccaaatggtagataatttgctagcggttttaggcagttgtttcacacatcttaacacatggttaatgattgtgtgactgagataactggatcagccctatttccaaaataagctaagtgtatttaagtaaaccttgctactattgagcattttgtagttgtttcatttactgcctagttttttttttcacttgcaactgatcacaagaatcattgaggttcatgccgttctatcacagtactagtagtaagaggtctttattttaaggatcttttgttgactttttcattacatttctatagccagatcaagtcaaatttacgttctgaagtatgtccaaggaaattaagagctggtgcatgaaaagataggaaaacaatccaaatcctagcagttatcaaaagcaagtttataatacaggcaagtgcattcactcctttctatatattttcagggagcaacatttaagagagagtaaacattcactcctttctgtatcttttcagggagtaacatttaagagagagtaagagtatttgtatctaaattggattagaataatttttttcatgtccctttactttcctgtagcttgctgatgaccgtatggcactggtgtcaggcatcagcttagatccagaagcagcgattggtgtgacaaaacggccacctcctaagtgggtggatggagtggatgaagtaagttccatgttagtttcatagcatcttgtttttttaagtaattatgacaatgtattttaagatatctgtcatataaacgaatttggctacacttgaatgtatatttctagaaatactttagctttaggttaagttgtctatgtgtgtgttaatgattttagctgtagttttaacattggtagtaactacctgaattataggaagaaattgaaaccccatgcaacaaggaagaatgtgattttctggtaatttgaattaaaagctgctcacacatcagcaagccaacaagtttgctgaagaccgaattctgtatgctgagtgtagctgatggaggcagaccatagcctgcctggcatcagtggagttctgtgacttcatttgcttagattcagtatgatgttggccggattaagcagaagatgaaagaattggccagccttcatgacaagcatttaaacagacccaccctggatgacagcagcgaagaggaacatgccattgagataactacccaagagatcactcaggtgaggagtgcaagtgagtcctggggaaaccagcgagccttctcatggcaatctcagaaactagagtgttactcagaatcagtctcctggagtcatttcccaacctgaagttctcagagggacctcaagaggccctgaagtcctccagctgtcagcgtaggtacctgtgaggccttggaggtatggggactgtttttcaattgttggcagataactgctgtggacggattaagtaaatatgaaatttcaaacattatcgagttcaatcatttgattttaaaatgtataactaatatcgtatactagtgttaagaaatttcaatgctaaattatagtcctcataattgaaaaaacaacttagtatcctagaaaaaattttttataaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacacgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaactttcttttgagtgccaatatgacactcaaaggaatgctcattggagcattttggatttcgaattttcagattggggtactcaactagtaggtattctgcaaatattccaaaatctcccgaaatttgaaatcctaaacattgccaatcccaagcatttcggatgagggatactcagcctgtctaacgtgatgatatgtgagcagctgggcacacagcaggccctacatagcaggagctgaaatctagtgaaatctttctgtgtatataaatgaagccacagattccttttatctgttcacctttctctaaaccagactgagtgaacagagcctctcacttctcactctggcttgtgatgtggcagtgttagcagaggggcttctctcccaggcttgccctgagcctcgggcttgttctcttagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgtgagtgctgcccgggcctagtgaagggattttgagtaagaaaagcactttatgttttcttttttgccactattttttcatttagtccagtacctttcattgttagcttttgaacatgctcataccttgtacagtaaagggaagcctcctccccatgtgaaaccctggcttggaatgaaggcacagcgtggggtaccgaccaaggctgggggagggcaccaagatagttcagcatctcagcaaacaaaatttgttttgtgtcaagctgcaagaatttgaaaatcaaccaagcacattttaaaaacctgttgttttctggatgttggggtttgggagagctgctcttcaataggtaaaaagcagttgttattactgaaagccacatatttgcataacaaccaaagtgtttgagagcacctgagaaaacctccccagggtccttgaaacacttcctctgctggcaccacaggtttcacccagcagaccttttcttcccaaatagtgcaaagccagatttcagctctcttctcattctaatcaccctgtaaactgggttttttaaaattgcccttgcaatcaataaagtccccacatactccaaaaaacctagttctccctccctctgacaactggcatatttgtattttaattttattatttccaaaatttgattagggccatatggaattcatactagagatgcttctagagagaaatactgattttttaaaatgttttgtaacagcagttagattaaatatttctgcttcacttagagattctcagatggttgtgtcatttttatcttggcatcaagtgaattgtgcacatttacactgtgacttttgtcttgagtaatcccaaatgcctgcatattgttgtatgtttgtaatcctttactctccctccacccccattggagataggcttctttaaagcggctaagaatatctcaattttgactgttggagtttactctagaattcccccttttaatggtagaacaatactcaggatggtttacatattcaagtaaaatgaattcctatctgtgataggcatgaagaatcgagaggaaagatcccagcattttttcgacacatcagtaccactaatggatgatggagacgataacactctttaccatcgggtacgtgaacgggctgcaaagctgattgctgtgtctgtgcaccccattctgcatctttcacctcctagacctcgatcttctgtgcagtgtcagtggattgatacagttgacttgtatattcatcaggttgttttgcagcaggtggaagaacagccgtactgtttcttcctttccaaaggccacagggagaccttgtaatctgctttccagagcctttgggaaagtggtcaacaccctgccttcttaggaagagcccagagaaacagagggctatcccgggggttttgtttatctgcccttgtggagttggcagacgtgggcttctgtcttccctgctatggcctcagagctttagatcctgctggtttagggaatttgaatctttcctgttagggaaaaatgagtgcttactgtgctttgtagaaatattttcagaattcattttctttaaattattttcattgtctttaaattatatctaaacaagtataccatagctttcctgagagggaaaacaatctatccaacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatgtgtgtgtgggtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaacttttttttgagtgccaatatgacactcaaaggatatatatacatagcaatcctaatcagaaaatatgaagttcaaaatgctccagaattcaaaactttttgagtgttaacatgatgccacaggtggaaaatccctacacaagacctcatgtgacaggttgcagtcaaaactttgttttatgcacaaaactagtaaaaatattgtggccgggcacggtggctcacatctgtaatcccagcactttggggggctgaggcacatggatcacctgaggtcagcagttcgagaccagcgcggtcaacatggtgaaaccccgtctctgctaaaaatacaaaaaaattagctgggcatggtggcaggtgcctgtaacagctactcgggaggttgaggcaggaggatcgcttgaacctgggaggtagaggttgcagtgagccgagattgcaccattgcactccagcctgggcaacaagagtgaaactctgtctcaaaaaatatatatatatatattgtataaaattactttcaagctatgtatatgaaacattaatggtatatgaaacataaaggtataagaaacattaatgaattttgtgtttagacttgggtcccatccagaatatctcattatgtgtatgcaaatattccaaaatctaaaaaaaaaatcccaaatccaaaacacttctagtctcaagcttttcagataagggatactcagcctgtatatgtgtgtatttacaaattatatacataggctactgtcattccctataagaatattaataaatctttttttgataaatgaagttctaatattctcttcccatgcctcgagggtactcatgtgagcaccctactctagagacctagttgactctgaccgagctcagcaatgattctgacgctatagaagatttcccttctaattttggcaggttattgtgtaatggcaattggaaccactagcgttcaagtagaattaaattgttgttcaccgttaaaatctgattagggcattttattatcttgccagcagggatttgggtcctgatccccctgaaaccaactgcagaatggagtgttcaggctctggaagatccagttacattaattactccagtggttcccagtgaactgctatctcttctaatccagcatgtttccaataaaagctctgttcttcctcatagcccagtgtccccgtcttccaatttaattgtttaagagattaaacaattaaacatcttccccttgagtccaaatttttaattttaggtggtagactggagtttaccatttcctgctctgacccatagagatgtggatccacgtttatagacgtgatagtcaatttgcaggtctacttatgacaggggcgagcttacctggtgttctctgcttacttgaatccaagtacgtaggcagcaaatgggcgcagagcttctgtgctgctcagagcctctgtccactggaccatagatttcttagggccccaggaagtccgaatatggcatttctatggcagctgaaaccaataaggaaacctcagtctgtcagtacttctttctcgtgagctagatgtgatggcactaaccagcattctgccatcgagctcctgacactgcttgagggtgaactccagagccctccgtgtgtacctgcagcacacagggaaggaaaacatcatcttatggatgatgatgtctgtaatttgcatatctcatttttgacgttcagttttcccagttgctattgttgattgtctgtaactgtcatttattacctagggtacagtccttgacagaattgactataacgttgaacagtcctgtatcaaaactgaagatggtttgaaacagcttcacaaggtaatatgtctttcaagacttgggaatcttaggaactattttcaaataatcaagaattggtaagagggttcttttccaccataacgatcttcagcattcttgtgttgtccactctcaatacagtagtgtaaaaagggattcatcatttcatttaaagccaattgtgggggctgttgccgttttattgcagttaatgattccaggtgtatctcacacttaaatccaaaattgctaagaactcctttttgtgacagtaaattctaaagagattggagttctttcttttagaaaatatttcattcttttctaatgcttcttgttttaggaaatcaattgggcatttgctaaaatatgtgttgaaaatctgtctgcttgttgccgttgacttgggcctctcttgtgatacattcctgatgaattgctgatggagaatcattctgcagaagataaaaatctaatcttctctttaattaccacagcatatctgtattaccttgagaaaagagaagtttgttgaagtgagagtagtaattcttttattctgtgctaataaggtagctgtttcagggatgtttttatgatattctcttttaaaaaaatagatggaaagcatcttaggaatcttatcggttataagaaacatgcataaacggctgagactctcatatataattggttacgtattttctttaaaaggaatataacaatacttcacaaattaaataatatccatttccttgtatctttgagacccagtggagtttctagccatataatgagtgttttgccaattcactgttggactactctaccatttttctgaaatcagtcgcttcctataccagagatcgccccatttaatagcagtattgggtttacaaaaagtcagcccttgcactagtctaaccagaagccctgagctgtcttttcagggggcttgttgccatgtgtaggtggatatgagactccagcctgtggtgggaagagaagtctgaccttgtctatgcagggtttttttaagcatttagattaatttggttgccaagccctgtctattaaaagtgaaaactaacttaagtttctcactctgtaatacccaggttttgatgtgctgctgaattatgcattggttttgaagtttcttaaataaaaactagtgaaatatgttttgtaatataacacagataaaaggaaaagctttctctgcgggagtgagcaaatctagtgggaactaaaaattttgttttaggttctactttataaatcattttgagaggttttacagtatattatttagtattggcttccctggtgttctgggttacttattagaaaagtcagcgtgctccatcttccctccagccacaaggctgtaggcagcacgcgcgtgctcggcagtcggctagtctaagggtgattgagcgtcgggagctgctccccatgaccggactctcggtgctgtccccgtgcctgatgtttcctcctggtggatgaggggctcctccaggtgggcgggcaggctcacttaggaaacaagcccaccgcgggggatggagcaggagagattgccattctcgccagggctgccttcccgctgtctcctcctccctcctgtgccatagcaaggtctggaagaggcagcgcatgctctccctggacgtgcctcccggcgccctctgaactctgctgtcctctggctctcctttctcagtgctctgcgtctttcgccagccaggtggggccctttggcatttctctagcaggcatgatggagttcccgctcctgccgagcttccaggatgcggtgttaaggtgaagagatgtgcagggtgcagcctcgtccccagattgagcttggagggctcctttgctgtatcgttagcggcactgggaggacgcgcctcagagggatctttctgcatatgacatccatggggcacacgtgtctgtttttatttcaaaggatgagtttttgtttccaaatttaggggaggtcgaaatggggcctcttccgggtgtctgttgcctacctgccaggtacggtcctccagcccgttgtttccttccgcggtgaaggaactgtgcattcgctccaggaacacggaccgggaacaggcgacccgtgctgcaggggcacttgccacggcctgcaggaggaaaagccgggagaagcaggcccagctgcacccggaagcatgagctttcacttccctgtcaggctttgtcttagtagtaggtttccaacaaatccatttccacgtccagggtaaataagcagcaccaggatcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaacaatgggttcatgttttcttccagtgcatttgtgttaggggagggcttggccagttttgtgatcctctgggcccctgactctgttttgtgcctgaggcctttgcctcagtgtccgaaagtagatctatctaatggatgctttcaaagggacaatctatttactatctgatatacaaaaagaacaactgcctaaaaggcagataagtatttttcttatgaaaatatatgctttatatacataccaagaaacatttggaaatctccaaataaaactgtgatgtgccttgttgagaagcaattcttacacacaggctgtaagagacttgactttctaaatgattttgtttcctactctgttacaccaaaaacttgagagacaagtgtctgccagtttaactcaaagccaagactatgtttccccttgattgtgcctgtcctggggtcctccgaggaggacctttgtcctgaaacttgactttgatgcatttgttttgctggtgggagatgtggacctgagtgatggtaggggtatgtggtttcatcaccagaacctatacaaacaaaaaatagcagctgtcatgccaggtctctttggcacccttggcgtttggtcctgaggtgttgcggcgactcaacagcagaacccttcagagcctgtcaacaaaccacacaaaagaaacaacctcctcctcttgcactctcaccgtgttttttgttaagaaattacatttccccaactcgcatgttggccactggctctgtccaagaatcaaatccactctcgagggagagacgtttgccatagggttcaagaatattctgaccggcaatgctatttaataacattgaagaaatcctccatcccgaaggggaccacataaaggcggcaacacctctttggtgacctcttgggttatgttctcagctgagtctttggtggcccagtcttgaaccagcactacaagagtatgcagacgcagtctgcagaagcattgctgtcagtggagagctgcaggatgccaccaatgacttggaggcatgacttgccaagaggcctggaagtggggagccactggggtgtccctttgaatgctcactttgacagcaggtaaacaggctggatatggatttcctctgtgaaatttagcaaccatcctataagaagtctgatcctgatccaacgtttgagcaatctagaatccttcctggtccgtctgccatagttacgtagccacaacaaaatttacctagcctagcaccatttctatctaaatctaataggatagcatgtcattctacatggggccttaattgtgatcagcatcccttactctagtcaagccatgtgggaccatgtggagagatcttttcacagaagggatgtccctagttgggtgtagagaagacagctcatcacaaagacttcctgcttctctgtggttctaattcatcgattagttatggtaagtttccattccttctaagatttaggtaggcaggcctggttcatccaacatgaactacatttcagaacctagcactgtgcatgcacataaatgcatgcctagaattgtatatcttggcgtatattagctcttaaaaactaattttcttggccgggtgcagtggctcatgcctataatcccagcactttgggaggccaaggcaggtggatcgcttgaggtcaggagtttgagaccagcctggccaacatagtgaaaccccgtctctactaaaatataaaaattagctgggtgtggtggcacacgcctgtaaacccagctaccagggaggctgaggcaggagaattgcttgaacccaggaggcagaggttgcagtaagccgagattgtgccactgcactctagcctgggcaacagagcgagactccgtctaaaaaaaaaaaaaagccgggcgtggtggctcacacctgtaatcccagcactttgggaggccgaggcaggcagatcacgaggtcaggagatcaagccatcctggctaatgcggtgaaatcccatctctactaaaaatacaaaaaattagcaggccgttatggcaggcacctgtagtcccagctgctcgggaggctgaggcaggagaatggcgtgaaccctggaggcggagcttgcagtgagccaagattgcaccactgcactccagcctgggcaacagagcaagactccgtctcaaaaaaaaaaaaaacactaattttcttgaccacccagatgccacttctaaccttgctgcctgatggttttaattctgttttgaaaacaacctcctcccaagtgatgggtattagaaggaactaatgagaaccctgggtgcaagcagagacttttagcacgtatgaaagtgcttctgatttaggactcggagttagatggtgggtgtcagctgcgtgtgtcttgtccccaactccatgccaccctcgggcagacgtcatggtaccagtctatggccaggctttcttactacacaaagagacattccatggagtcaaatggcagagacttgtgtacaattatctggtcagttgaggcaaaagaaaataatcatttgtccaattgtccaaattagctctgtggattgtcctgaatgctcggggtaactgtgtggttctccacttcagttccgtaacctggctaagatggaccatttaaatgaggctccattcaacacaatgcacatttaaatgaggctcagttgcaagagaccactgggcttagcgttttcaatttgtcaactataattctataattgcttttagctaatcatccaaatgattacatgttgtaatggaggcagaagaccctcgtatgcatcatttggtctctttttctcagaggaagtgctgaaggatcaaatgttttgtgtgtctctgtgtgtgtgtgtgtgtgtgtgtgtccgtgttttaacttggtgttctgacgcacaacaccataatagacctccattttcatcaacggtgggggaatgagaacaacgccccccatcccaacatcccccttttccagagggggaaactgagacccaagtttccctcttgccaaggccacaggactagaactagaatcgtcagttttctgatttccagatcaggactatttctgcttatgccattttaatttttcatttctttccataaaattaaatgaccttcttcaagaaagatttaatggtcaagatgcgatttggtaaaaagcttcctcaaggatttttttcttattacaaagatgagactggctgaggctgagagatttgcaagcagtggtatgtcattatccccagctcagttttttgtgtaattggtgtgaagagattgctgctgatgaatcagcctgctgctcaacagaaaataatgattcttttgtgacgtgagtcagtgtacgtacgtgtacgtttgtggttgtttatgaaaggtatgtgtgtacataaaatgcttatcaagatggataatgtcattttaaagtggtaaataataaaaaatagtcctgagcaaaactgattttacaattgcctgagaatgcagcacttcattttaacactatgcaatggctagaaattgattttttttttttaaatccaattaagcctcaaggttggttatccatttaaaaggtcggatgagttaaacaatgacagtaccttcagttcgtgctaataaatttgcacagaacttcagcacttacatcgtgtgcctcacagaggcatacattttgtatgtgcacaacactgaactaccaaagtcccagcagtggtacagatacaccagcagaccctggaccccaactgggggagtccctgagctgaccgccggccctatcacctcttccacttagatccccgaagcaccccccaccccagagtgctgagtccttccatctacctggcccccttttctgtggccccaagagcactgggagatgaaaagttgcctctcatttaaaaggggggaaaaagatgtattcactacttggttttgtgtgctgctgagtttataatgtaacaaataaatcctgttttaaaaatagtactttatagtgtgtatttactgtgtattcatagtgcattaagaaaaagacttcggccgggcacagtggctcatgcctgtaatcccagcactttgggaggcagaggcaggcggatcacgaggtcaggagatcgagaccatcctggctaacgtggtgaaaccctgtctctactaaaaatacaaaaaattagccaggcatggtggcgggcgcctgtagtcccagctactaaggaggctgaggcaggagaatggcgtgaaccagggaggtggagattgcaacactgcactccagcctgggcgacagagccagactccgtctccaaaaaaaaaaaaaaaaaaaaaaagaaaagaaagaaaaagacttcggctgggtgcaatggctcacacctgtaatcccagcactttgggaggctgagatgggcagatcacctgaggtcaggagttcgagaccagccttcccaacatggtgaaaccccatccctactaaaaatacacgcccggctaatttttgtatttttagtagagatggagtttcaccatgttggtcaggctaattttgaactcctgacctcaggtgatccaccagcctcggcctcccaaagtgctgggattacaggcgtgagccaccacgccaggtcaattctttttactttttaaaagatctacattcagatactacagatagatgtataataaacacaagggtgtttctggaaaaaaggtgactcaggtttttgaagattgaatcattttcaatgctctagagaaacatactatttaaaaggatcctataagtgaaggttttcctaacaaaagattccttgatcaaaataaacatttagctcctaattttgcttttctataagtctccattttcttgtactgagtttgcttaaaggaatgcggaaccccatttggtctgttaattatttctcttttccttctcgcagcctccctatccaaaggctccaggtcttcaacatgtccttgaaaacttttgcaactacaaaaataattttgctggtgttcagaagtaaatagagtttagttcctgagacatgaaggttattgctgtattacactgtgcccttcctgggaggataatttaggctgctagaatggcaagggacctcggagagcaactagttcagcccgctcattttttttttctttctttctttttgagatggagtcttgctctgtcgtccaggctggagtgcaatggcatgatctcggctcactgcaacctccgtcccccaggttcaagcgattctcctgccccaacctcccaagtagctgggactacaggcatgtgccaccatgcctggcttttcgtatttgtagtagagacagggtttctctgtgttggtcaggctggttttgaacttccgacctcaggtgatctgcccgcttcagcctcccaaagtgctgggattacaggcgtgagccaccatgcctggccccagccccctcattttatcgagaggtcctaaaaactgatgctagaagagacgttttttgttgttaataaatgattctgctggtacatttttattaacacattctctcatcccactgatcccagaaagtatagacacagtacatgcagatgaggctaccaaatgtgcttgtcaagcaaagtgcaaaagatggcatgtagtatgctaccttttgtttaagatccatgaataatcttatttttttcaaatagaatcatgaaagataaaagctaatacaaatggttacctatgggggtaaaaaaaggttacctgtgggggtaaaaaatgctacctatgaaggatgactgagaaaaggggggaagggcaggatggggagatctttgaacatttcctttttataggtgtgacttgaatgatacaaaatgttatacgtcgtcaaaaaagaaaatgtagaaaaaaggaaaatggcaaacctttctgtgaagcacagatttatgaacctaaatgtacatcaaatcagtaagctgcacaaaaatcaagtatatgtggaatatatccctggaatatactcttaggaacaaaaagttaaaacatcttgaactctgtgttgtgggtttgttgtcgggagcggaggctattggtgagtgttgtgggaaacagagtgagaaaccctaggaggggctgggaaccagggtcctcactgtggcagagggagatgcgattatggaagatgggcaggtgaggaaaagccctgtcacgtggatttgaatgggaggaatcagtatcaactcatgatgttaaagaaaacctgatcttaacagatccaagaggaccaggagcaatgacgcccaagtggcagggagcatgcccagcacaagagcttggtctctaactctgaagctgttggctctaaccaaccattcccctcactgaatggagctagggtttctcggagaaatggctgactctggatttgggtcaaggaaggaacaaagtgagcctgtgatcatcttactgttccaggaaggacaaagtccttgaaaatggataagaacacatcaaaaaggagcctgcctgatgcagctctcattggcctaagtggggacacttgggagcagtgacgtttgatgagatgcacacacgtatgggctgtggcagggctggcttcaaggatgtgcagccaccatagccacatgggccctgtgcctagtttagtgctcagctgttgccatcttgaaattgctttttgaaagagaggcgctgcgttttcgttttgcactggactccacaaatcatgctgccagccctggggagggggaggtctttgctgaagaacaccaggtagtaagtgtagaagggaggatagagctggaaagtcactcaaccaatacttgattcaggcagaaatcatcactggataccaaagacattcaggaatagatggttgagacccagacggttcttagtctcaaagtgtcactccatggattctaaagaggaaattataattcaattaattataaaagggggaaatgcacttttaccatgaagagatctggcagaccccacttgcccaatgatgggggacacttagtttatgtgcctcctgatgaggttcgatgggaaccataacccgtatttttgccaaaaacgttcaacccaaatctaagaaaacagacgaatccagatggtgagagcttctgtaggatataccagtgcatgaaagacaagggtaaggactgttctggattaaaggaggccagagaggcttcacagccaaacgcaatgccttatttggattctggatttaaaaagaaaaagccatgaaggacaaggggacgattaaagtttcattgcagactgtatactggataatagtattgtttcaatgttaaatttcatgggtatgatcagcatatgatcatgattatgttggctggtgtccttgttctttttttttttttttatactttaagttttagggtacatgcgcacattgtgcaggttagttacatatgtatacatgtgccatgctggtgcgctgcacccactaactcgtcatctagcattaggtatatctcccaatgctatccctcccccctcccgccaccccacaaccgtccccagagtgtgatattccccttcctgtgtccgtgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatggcgccataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgcgttttttggctgcataaatgtcttcttttgagaagtgtctgttcatgtccttcacccactttttgatggggttgtttgtttttttcttgtaaatttgtttgagttcattgtagattctggatattagccctttgtcggatgagtaggttgcgaaaattttctcccattttgtaggttgcctgttcactctgatggtagtttaattccttttttttttttttttttttttctgagatggagtttcactcctgttgcccaggctggagtgcaatggcgcaatctcggctcactgcaacctgcgcctcccaggttcaagcgattcttctgtctcagcctcccgagtagctgggattacaggtgcatgccaccacgcctggctgatttttgtgtttttagtagagacgggtttttgccatgttggccaggctggtcttgaactcctgacctcaggagatctgcccgtcttggcctcccaaagtgctgggattacaggcgtgagccaccacgcccggctggtgtccttgttcttaagagatacacaatgaggtaggggtgtatacaacttactttaaatggtacagggaaaaatatgtgtacatacatacatatacatatacacatatacatatacatatatacatacacacacatacacatatacgcatgtttgtgtatatagaggcatacctcactttactgtggcggtctggaactgaacccagaatatctccgaggtgtgcctgtatgtgtgtatatatgtgtgtgtgtgtgtctatgtgtgtgtgtgtctatgtgtgtgtttgtgtgtatgtgtgtgtctgtgtgtgtatacatgtgtgtatgtgcgtatatatgtgtatgtgtgtgtgtggtgtgtgtggtgtgtgtgtgtgtggtgtgtgtgtatgtgtgtgtggtgtgtgcgtgtatgtgtgtgtggtgtgtgtgtggtgtgtgtgtgtgtgtatctgtatatatatgtatgaatctaggtgaagggtatacaagtgttcattatactagtttttcatcttttccaaaagttaatgaacttttcaaaaaagtttctagagaaatgtgttttcatggcaacgagttctctttcctcccttcagggaacatttagtgcaaatctaggtggcatgtctggtgccagttgcaaaaggcaacggaggccctccctgctgtgcaggcactcaggttgcagcaagggacagcacaaacatccacaacgcagggcagcattcaaggcggtcgtgcagctgtcacagttttcactggttgtgggctcacttctcagccagctgctcagggaggtccttggagctgagcctgcctctgcttcctctgggctcacgagcaggtcattctgaagcaggaaggagcccttccttgcttccacttcaggcctgcctgaggcacttccactggtctccagttacttgcaaggtcaagtacaacctgcaaggtcagtatatattttatgcgcactttatatctggcacaggagcttttctttttctttcttttttttttgtagagacagagtctctgtcctgcagattggagtgcagtggcgtgatctcggctcactgcaacttccgcttcccaggttcaagtgattctcatgcctcagcctcccgagtagctgggattacaggcatgcaccaccatgcccagcttatttttgtagttttagtagagatgggttttcaccatgttggccaggctggtctcaaactcctggcctcaagtgatccacctgcctcagcctcccaaagtgttgggattacaggcctgagccacggggcctggttccacatgagcttttgacagtgccagaatgaaccatgtcctttactacttcaggcctttgcatgaacaattccttggtcagggatcagactgcctgacacactttaaccgatccctccaggcccaactcaaaagtctcatcgtagtccaaggggccttccctaactcaatcttctcccagtgactggatctctggattttactgttctacttgcttccccttcctcctcctggccacacacacatatgcgtgcacatgcacaaacacacacacacacacacacgctattgcgtccccaaagcctcacgggtcctgtagcttttcagaactgatgttcaacaaatgtatgtcaaatgaatgaatgaatgaaaatgctagaaaatacgaagcagatgcaccgaggaaatgtttctttgaagtatcggatataatggaatctgagagcctcgtggcaatcagctgagtctaagcaggcattaggttttataggggtgaagtctgacatgaaattaacatataaatgtagatttcaaacacctagagccatcttacaagataggatttcagaaatgtgtcctagaatgtgaactgtaccaaaaaacatcctagtaagttctaggagctttattctgatttgtcccagaagtttttaatcttttcttcaactttggagcaaagtctgaacatccaattgaatgtggaataggtttcaagccatcaaaaacataagttgatttttgggttgcattaaagatctggtaatttgttttaaactttcattttttaaggaaaattaaatagagttgaatttttcattgacagtgaaatatatagtaagccatggattaataccttcataaaaatttatctaaacaaagtgctgcctgtcttatttatgttaaagtctgtaaagtcagcagtgaaaaagggaaagtactttcctggaatgtatttgtatctgtcacaagctgaatcttgaggaaattggcaggcatttgaagtggaataattccttagcgttctgtttagtttggatttcttcaattcgggggtggcttaaaaccagaatcaccaatatttgcttttaacaagcatctaacgttttctcttgctttgtgtacactaagtgctcaacaaatgttggttgaattgaatcattttgttcatcctttctggggactgtcagggttattcagtctattcttaaatatgaaagaattctaaaagaaaaacatctccaaaatgacctctccaccaacagtttatctcatttccaactccttgtacacaaacctgctagatctggctttctgaaatgcttcttggatccctcttcagtttgcaaaattctatagagtgagccaggctccccagtcgatctcctcacccactcctattttccaggaaccttctgttctaaccacacaggtttcagagcctgctggacatattctgcgtctgtgtttcctcccaggacttctcccacgtggaaggccttctttctcaatctcttcgcctgtggaagtcctattacatctgtcagggcatggccttagtctctcaccctctaggaagatcctccagctgtctcagtcctctggagtgccgtgtgcctgtctgcaacgtatttgcaaacagaaaaaagagtgagagatcttcatacacactgttagtaccctttaccaatgtgtgaaaacattcagctgctgtaaaatcttttgaagaaaataagatccaattagcgttgacttttatgtcgggaaagctgagggtttcaaaggaatgcctttcagtcattcaacagctttttttttttttttttttttttttttttttttttttgagtgcctgctctgtgccaggaactggaggaaaaaaaaacaacaaaaagtcaaaaagacctgccttcaggatgctgaagctctagtctgtggtgtttccaaggggccagggaccatggctcagagctgagcagacagacctggagcctgtggacagggaaggtgaaagcctggcttgtggctcccggggctacaagttagggagctagggggccagctgggaggtcagtggtggaaaacctctcacaccacgccagggagttgacagtgcttttttttctttttttcttttctttttttttttttttttttttcatttttaggctggttatgaagaagaaactcaaaataacaggagtggcttatggaactacatggaggtaacagaggagggtaccaaccaaaggcccttgagcaatcaggatgttgggtaacagatttttgcttttaaatgactcctgggtggagcttccccaatgcatcgtcattccctgacccttgcatctgaccctgtgggtgggaccctccgcctccaccatccactcaaggctcacccctggctcctccaccacccggctcctgccccacacccccgatggcctttcctcccctgtaaggcgactgaggtgactcaggtcaccctgctccttcctcgtctcatctcgtccctcctttcctgcttagactgtgccagatgacccttcttgcaaaggggtgggcgggaaggccccccatgcagccaggcagtgcctggatttgtaactggccatcccagcagcagtgccctggatggaaagccacgtccctgtcaccctctcacatccagggcagtgcctggcagagcggggtctgataaacgccagggaacctccgattaagtgaggaggaagtgaccgtccacgctgtacccaccatgccaggcagtgggacaaaaggacctgactcaggtccaagagtcactgggcccctccggcctaactgatgggtggccagggtgcggggtccctggggatcaaaagcagctgctaagggacctcgggggacctgcttggggccagcctgaggcctgaccgggcggaactgcgtcgggtgggcttgggcctacgtcggcccaggccccactggaggccaggcccgtccgggaggcgctgcctggcgggccacgtcgccccgcgtgttgggcagggccgctaggcccaggggcggcgccgctggaggccgggcgcgcgggccctactcggcagggcctgctcggggccggcttcgggcctgcccggccgggcctgcccgcacccttccgcccggcctggccggcgccccctcgcgccccgggcgggccctgcacgtctcgcgagcagcccggagcggcgggggaggcggggcccgcgggctgccgggcagggccggggcggtgccgaggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggaggtgagcgggccgccggccgccatgcgacccgcgccgcggaagcccaggcccgggcggcccgcggaggccccgcctcgcccgccgcacccccgccgccgccgggccgggcccaacgaggccgggccgcctccctgaagggctcagccgccaggccagtcctcgcccgcggaggcccagccccaggccccgtcgccggtgcggcgcggtggtcctcctgtcagcccagccctgcgccccgcgaggccgcgacacctgcggacggcggggggggagacgtggccgctcccagggccgcgcgtcggccccgcctggcgacaggccctggcttccagaagttcccatggcagtgtccccagctgcctttccttggggacacctggcccctgccccctctctggtggaagccgcctaagccctatccgagtgttggaagcaaagcagcccccagcctggcccttccaggcttggtggcttcatcccaccagggggatgcgagccagcctagagacagttagctctgcagagaggcgacacatctccctaaggatgggaaaacggtggccgggagctgcgcagtgcccttccaggactgcaggagtggttgtggccgtggctgcagggcagggcctcctggcacgtggccgctgtttgaagcctctgtgtcttgtctctcccttctgatctagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtggtgagtgcttcgagaggaggcagccacggtgctcctagtcgggcagcggtgagctcgggcctggggagctcacagccctgctcagactgcagcgcacgcccagagggctgtggacgttatcatccctgctctgtagacagggaaacaggtccagagagacgcggggatttgccccagatcagttttggtggcaaatcagagactcaaacctagatttcctgaggcccactttgtgtctgtccctctgtccctcattttcatggctggtcaggctgttgacatctggtggccaatgtgttatttctcttggagcatgaccaatggtggtcccatggttccggggatgacctgagggatggggtggcggctgctgtgggacatctctgtctagatgtcacctgccagggagctgatgttccggaggcgttcaaagagcagctccctgcactccctggtggcggcccttgcacccctcacgccgtctccctatgtgccacagatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcaggtgggtgtctggaagggcagacactgcccctgggcccgggcaagatcgggcaggtgggagggaggtcgggagagggaaaagcttgttgcgggggcaggagggggttcctgcccttcccaggagctttggttcctgggaagcggcagaggcttttccaaacccaggccccctgcctctgcctcagcgtggtctgtgacttcaggattctgttgtatacaggcagtgtttgttgagcacgtaatcagtgccaggaacgtccatgctgttttccaaataaccctgcccgtttatgtgagctccgtgtgcacgtgtgtgatgtatgcacgtgtgtgtgtatgtgcgtgcacatgtgtgttgctgtgcgtgtatgagtgtatgtgcatgtgttgtatgtgtggggggtgtgtgtgtgcatgtgtgatgtgtgtgtgtgtgtggtatgtgttgctgtgtatgtttgctggtgtgtgcatgagtggtgtgtgtggtgtacgtgtggtatgtgttgctgtgtgtgtgtgtttgctggtgtgtgcatgagtggtgtgtgtgtgtggtgtgcatgtgtggtgtgtgcatgtgtggtgtgtgttgttgtgtgtgagtactggtgtgtgcatgagcagcatgtgttgctgtgtgtatgagtgctggtgtgtgcatgagtggtgtgtgtgtgtgttgtgtgtgttgctgtgtgtgtatgagtgctagtgtgtgcatgagtggtgtgtgtgtggtgtgtgtgcatgtgtgttgctgcaccctttacagggagcacttctacatgtgttatttcactcaatgctgagaatgatccttttgaggctgcaaggccggaagtgatttcccagctccagatccttggatgggcctgacatcaggctcctgtccccacggcagcggtcccagcctctgcgcctgccacctccagtccccgagcccacagcgccacccaggttgtcttttctcatgtgtcagcgctcattcttcacttctggctctggaaggctgtcgccttcacccaggcaagctctcccacatcagcacttgggccacacctcatttctttcactgtgtgctctctgaggcctgtaaccactgcccctcaacccaaattcttccatcttcaccagcatgagatagctccccttttttcccttcgtctctgagcttttaaaaaagtctaactggtttgccttgcttaatcctcttttccctcttaacccatggagacagagtttttgcccccatcctgacattgttttctaaggactgctggatggggtgttgccgtccctccttgaagtgcatctgccccatccagaggtctccctccctcccgctgctccccagactgctgccacctctcggcatccccttcatggcctctccagcgttccgacctgctcagccctctccgggtcagacaccagcatctgcctcttctctctgtctttagggattttcttctgacttccaggcctgccatccaggtgggcacgggtgcccgcagagcccaccgggggctcaagcatcacccttatttccgaggacagcagggcaccctgacctctgctgccctcagtcccttcccctcctgtggacttcctgctgtcccttagactggccacgcccactcctgctcttgctcctctgcaggggtccttccctctccagcccagcatggtctccatccagcctctgcccacattccctccccagggaggcctggccctcttggctagcaccaccctcccatttgtcagctaaaccatcactactagacatgtcacatctttgttgatctcctgtgctcctcactgggttgggagtccccagagggcagggacctggtcttgtgcacagtgatcccagcacccgaccccacacatgaaaaaggcccagtaaacatctggtgatggaaccagtgggggcagtcagtccccatggcccccgaccccattggtcccaactagctagtgtgtcctgtttcttgtctttgctctgcccagtgccgtgccttgaggtgctctcctgggctgtggcagcagtctcctggtcaccctgccacagatggcctccttccagctcctgcgtcactcgccttccaaaggcacatctgggtgtgtgcaaggtggcatcttctgagtgctgtcagctgtcaggccctgcgctgaggcaggagtgtgcacacagcacgtgctggtgcactgaattctcactacagccctgtgagatacatcctgttgtccccacgacattgagtggctcaccggggccacggcagcaaggggcagagccaggtgttaagctgcagctgccaccactcagccctcttgggtcctgagcacaccatcatctgacacccacgtggcctgtactcagcttctcccttttcttccctgcgggaaccttccagtccccacccaggaccctgtcccctctgcatcctgtggcctcatcctcttctgtagcagggactgggactgtgtactgtgagtctctgctgagcttgactcccttggacgtctctgaattctcagagtcttgcacgatgcctggcacatgtggacagaatgagtggtcctcctctcatggtaagggacacccttccccagtgcagcatggctgtgtgttggtggagggcacccgcagccctgccctccctcccacaggagcgctcttgcgtcagagccccgagctcgccgtggtctggggtcttccaggtgacacctggcctccttggaggcaagtcacacagcattgacgcacttctcagacagtccttgtcgagtccccacatgccctcacagacagagaacccgctgacaggcggcagggacggctcaggcacattcatatcagagctgtcaaggtccaggtttctacctttgaggctttggggtttaattacctcggcagggcgggggaggtggccaggctgcagtatcgacccggcgcctgctgccctgacattatgagactagaggcagggatgataaacttgctgctgtcctgcacccccgcaaaacagcgctgctcttctcttaatattgtctttctggtgagcaagggaggccgtgcaagcagccagctgtctgaagcttctgtgcctggggatgcacagtggggaacagggtggggaaggggtgcccgcagattcagctgagagagagtgaagctcccagggcagatgtgagacacacatgagaaggcaaagaatggcccaagccagggctgaaggacacatttttgggacccacgtgatgtgtgctttggtgcatgtgcccctctctgccctgccttcgagtgtgggctctgaagccctgccaggccagcagggcccatgttttcagttcctgggtggacacgtcagttccatgaggcgagacctccctctgtgtccttcccctccgtgcccagaaccgtgctgtgtcaagtgacagcactagggcagccagacccccatctgtcttgcagggtttatgagggacttgcgtgggactcatgaggaaagcaacggcccagagggaaggcgtctgggagggccagcaggttcaagcactcaggatgtagagtgcttctgcttggtggggaggatctggaaaagctactggtagatacggcctatgagaagtgcctcgaaggatgactgggatcttggtgggagggaaaggactgtgggatctgcagaggtgaggcgtgggaagctcagggcatactcaggggctggcatgagggccacctaccttcagttgtagctggaatcaggggagaaacaggacacagggcttggaaaagatccagatacagaagggcaggaccccaggctggggactcctgtatatttgtggaggcgcagggtggtggctgtgctgaaggttctttctacaggtggccggtggccctgggttgctgggggtggggcaggcagcgagagccatggtccccctctcccctctctttgctgccctgtcagtagccctgtgggtgatgtttgcctctgctgccttttgttcctgggggatggacaaggggagaacatctgcctcccacctggtccccagtgatggcctttttctccctagtgcttagcgaatgccacagacggcgtgcggctagcagcccgcatcgtggacacaccctgcaatgagatgaacaccgacaccttcctcgaggtttgtggcgtcatcaggccgggggtgggaccaggctggggtgggtgtcatagactcccaggagagccagaggaaacctggggctgtccacaccctgacgtggccagggaacctcagggctgccctcggcggagcgctgctgtctgccgggctccaggaagcctcaggaaagggtgtgtggggaggacagagcctcctcttcaaggccccttggcaggaccacagccagagctacaggaaatgagagtgtgtggagggtgagccccctcttctgggtttcatcacacgcgaagctggctcccaagcccggctccccgacgcggcacaggcagcggttcatccctggccccagcctcggcctctcctgtttccagccatcttcatgtgttgttgtgctgttgttttttccatgaacatgtccaggagattaacaaagttggaaaggagctggggatcatcccaaccatcatccgggatgaggaactgaagacgagaggatttggaggtgggtgggggctgcatccctgcagctcttggcctcgggcagtggccaggggcacttgggtggcagggggtcggcgggccacatggcacattgtcccaaacttcatcctgcttgtgacctgaaaggaatcagcctgtgtccaagcccagtgccggaccctgggaagcagccgtccctgggggagaaggggaggcaatccagattctgatttggattctggaagctgctagatccaagtccttccctgcctgcagcctctccagcgtcctcgcgtgctgcacacccttactcctgggactggctcagcagggcctttctgttccttgaatacacaagttcccatcacggcaggcagggcctgtgtgcggatggctctccctatctggaatactttcccccaagatatatttttggtggaggccatctcaaccaatgccccctcctcagagaggccttccccaagtccccagacccacctttccccactgcccaggaaccagaggggcagataagtatgactcagctgccccgtggtgcttgtagactggcaagaggaaggcggctgtctgtgttatgtgtggctacaaaacaaatcactcggaagatagcagctgaatgcagcaacacttatcccctccccgtgctgtgggttggggatcttcccctggtgcagcgtctctgcctgctgttgtcaggttgttggctggggctgcagtcatctgagggcttgcctggggctggcgatgtgcttccgggcaggctcacaacaggctgctggcaggtctcagggcctcacaggccattagctggaggcagcaggtccttgctgtttgagccaccctccgagcaaggtctctgagcgagagatagggataaagagcgagcaaacaagatggaaactcccatctttttctgtgacctaatcccaggagtgatatctcatcacttctacctttttcttttggttagaggtgagacatcaggacctgctcacatgagggggagggactgcacaaggacatgaatacccagacgtgggggccacaggggccatcctggtggtgtctacctagacaggagccatttacaagtggagggagaggccgcttgtgtcaggaaaagcttcacagaggaggtggcatttgctgtggatcttacaggatgagttggagtttgtcaggcagccatgattagctctcgtcattgttgctatgattgtttgactcaattattgcaggactttgagccatagactctgcacacgcacaggccacagctttcttgagaagatgtgtcatgtaaaccaaagaggcagtggtgcagggactgtgggagcgagtgtgaaagggcggtgcagtccctgagtgctcaaaggattcaggaagtggggacgagcatgggctggggcagccttgaggtgttatccaaacatcgtttcattctgcaatcctgttcttttctttctggaaaggatacaatatttttttcccttagtgggttttcttgcttaacaaacaacactttgcatagaatttgtttgcaatctcagacattggagctaatttgcattccccaatcccacactggccaggggcaggagaaggggcagggagcaccaggctcaggcaggcggctctccaggagaaacaccagccggccagagtttccaggggcctctgggagttccccgctcagctcagcccgagcctaacccagttctccccacgctttccataggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaaggtgaggtgcgggctggctctcagggtgccctgggggaggggaggggaaggtgaggtgcagggcccggctctcccgggtgccctgggggtggggtggggtggggtggggaggggaaggtgaggtgtgggcccggctctccagggtgccctggggttggggtggggtggggtggggaggggaaggtgaggtgccggcaggctctccagggtgccctgggggggggggaggggcccagtttgggtccagccagccctctgagaggtgtcatggggtggggggcggcgaggtttctgggggttctgggttggggtgggttcggggagagtgcgcagggcgggttcccatgtgctgaggcgacagcttcacgtggctccctgggtttcatgcccacccttcagaagggtctggaaacaaaagcctggccagggcccaagagcagccccggaaatgacggaagaaatggcaagcagggccagggaggcagggcttgctgcttgggggctttgtcccgagaagagaagggcaaggggacgcctgtgtctctgagtctgcccatggtccccactgagaaaacgctcagagtggccacacaagaccctccaaaggcacgtgacccccaagagcgaggggaatctgggcacggcacagaagcgagtcacccgggaacatcccggtgcggtggccctagaagcctgtcccgtggtacggctttctgtcctgccatcccaggaggacaggtgcttgtggagcccccgtcgtggccgagtctgcccgccccagcaagccctgccctcctccgcaccatctccatccattcatcctacacaccgtgtgagcagcctctgtgctcaggcctgggctgggaaggacagggagggagcagactgggaagtacatacctcaggaggtctggaaggagcagggagtgcatccgcagcagacactgcaaactagcagcctgcaaggctcacggaggcctggcatttttaaaatttgaattagctaccaatatttgaaaccaggaaggattctcatcaaagcctggatttccggccttttgtgcactcagaaggtctgccagtgctggcgttctgttcccgcctggcagcattcccctgcagccagtgggcctgcccctggtgtcacccattctccagtttggtttgcggtaggccccaccacttgctgctgccttcctgacactgagccctagtgtcagctgctgttcagggtggcgctggtgcagctcgccgcgctctctagcacgcctagtttatttcatacctggagaggatgagcagttcccatccctcctctaaaccacaaaactgtttagaactaagcagaaaatgacactaatcataaaaagggttttttgtttttttttaatagaaaaaacatgcctccctatgggtctcttggggtaatagatggtggaatgaatgtttgtttctggctttgggtcttagcatctacacgtttgacaatggtttcatttaaattgatcttctttactaatgtatgttcagtaggcagagttgccagctgtcttcactcatagttggtccaagaatactatctgttaactttgattttgaagagctccaatctcgtgaggcaacagatacacagatacttaggaaaagtctttaatacggtatcatttggcagagattcttaaaaatcccatttcacagtaaattccagcaatcacaacacccactgtgtgttcagttcttcagggtggattcttgtggctttcagatgtctgcagaacaaaagcattttggacacagtaactccaagtgttcacatggaatgagggaagtgaaggaacgcaggttccgcgtcttcgttttgaccatcccgcactctcgtgttttattttgggtcctctgtttcgacaccgggaggtaggaaatcatgggccctggaggccccgactgtgcccagagccagcccacaggatctgactgtcagagcgattctcagaaggaatgtgggtagtagattttgtgtcgggtcattgctaacgtccatgtaatgttactttcaggataagtaacaacgatatgcgaatttgaagcttttgtttgtgtgattaaaacgcaaccgtagccacagcaattttttaaacttcaatcaacaacagattttcggaggaggaatatgttattgctgactttgttcagagataccggcacacggtggtaataagcaaactgacttctagtcggttatgattcctaaattcgccacagatagtgcaccccctactgcctgcacctggtactggctgctcccaccctcgcacgcaccctcaatacccacggtcaccctggaagccgctacattctggctggtagagtcgtggaccctcttctccttggatcagatgcttgtttttgatgtcggcttgttgtggaccaatgtgagaagatgagcttcctgggaattcattcgtttgcttgtggcactaactctagtcacttagggaaaatatcgttgcacctgacttcatctcatgtggctgtgggtagacctgtgcagttagtcagctcccggcctggaaattaacacaaaggaaaaacctgaccacacaggccttccctagaggccacagctgcacagccttcagggaagctgtggtctgagggtggctggtagaactgccagagagtagggcattttccatggctccagatcaccttctgaaaatgcgactatagcccctgcctattcccggggtccacctggtctgcagaccccataataccaggaagagctgggtgttctggcaccagtgaaacaatacctggttttttattttaaaccagcccatcttccccgctgcagttggaaccgttctacgtggatttgggatcaaccagcaggcctttcctgagctgttactgtgtggagtgggcgctgaggctccagccattgatgcaaagaccccaatcctgacctgaaggcgctcacaatctctccccaacggcctggtgtgaaacgcagacgcaacgcagcaggcattctccccagtggctgcctgtagagcaaatggtgcagaaatggtcactcctcaaaaagcaagccggctggagccagcccagctcccagttttgcaagaaaaaaaaaatcacagctccattttcaaagatttcaagggcagctcaagaccagcctggactagcaggcctcaaatgcattactggagacccctttacgctcttaacaagtaccgaccccaaagaggctttttgtataacaatgtctattgatatttactctactggaaattaaaagtgagaaatttataacatgtataattcattaaaaataacatataaatccattgcatgttatcataaataattttatgaagataagcatcttccaaaatgaaaaaataatttactgagagagtagcattgttgtacattttcacaaatcctgtcagtgtctggcttaatagaagacagctagggaccttgcgtctgcttccgatgtagtctatggaaatgtgttgtttcagttgaactgtatcaagaaaatctggcctcacgcattttatagttgaaacagggaaaaggattttagtacctttttcagctaactaactatgaacattctttgctactacaccaaaactcaacaagtggtagcttcttaaaggctggttataacatggaatctgaagcctcatgaatagacttttgggctctgtggcagttaaatccgctgttctctctcactttgaacatgtggtttttcatggaaaaatgaatgttcacttgaaaaatgttggttcacagagttctgcagaaattcaaatttttgacacattacattatatagtatcaaaaaatcacttaatatcaccatccatctcatcagaaaactcattatgaggaagttgtcatggtgataggagaaagtttttcaaaattctgatttttgcttaaaagctcaaatgtataccattggcaataaataatgtcagctgtttctggaagtaagaggctcagtttgttccttttctgggaaatatctgccagatacctaaatccaattaaatgccatttgtctgtcagtttttctttcaagtaaagatggtgtcgtggccagagtggctcatggagctcagaactcccccagcaatcacagctgagcttctgctctgaccgaccactgcccgtcagcaacagcaggagtacattatgagtcacacggaatatggaaaatgtattgtacccaagggttgagagttttaaaaattaattttactgcttcagcaaggaaattctaacgtgaaattggcattggttcattttcccagagggcacggaaacgaatacagtggctcccggacctctttgggactgtggcctgatactccagcacagggggtgtaagtgtcagccccgtgaaaaaggcagagaccgtcttaaatcactgcgaaaatggtttcttctataaaaacagaaacaacatatgggggctggtgaaactttgcacaatcaatcagttgagctgtatttgcaagcccagtcctggctccacctgcaattgggaaggagctggcagctgtgacgggggagacatggtgtacagtgagcagccgtttccaggcattgctgtgtgacccattttgcacatggtttgattccagatcggaggccctgtttttccatttaaacaatcctgtgctttctcaaacagattagctcagaagagatggcttattttcagtagtacaagatgggtcattttcactcaattataaaagcagctcaatttacatctaaaaatactttgcactaaaattcaaagcttgtgtaataagataagggttcaaaaatgattcagtaaatttcatacccaaacctttacctctgaggacctgctgttaatttaaaatatgaacttgtgaatttgatttgggaacctgtaaaatgtaaaaatgtgtaacactgtcaaccagcgtataggaaacagtgtggacactgcaggagaagggtggcccctctttagacccaggttaaccaggaggtgtgaactattaaccaggaggtgtgaactagcaggagggcagaggtggccccttcttctggcgatagacctggcagtgacatgaaggagcgacaggtgtcctcactgctggtggtgtcagtgggggtggatgtgactgattttggcgaagagttcacatcaaccctcaccatcattcaaggttgtgatgaggggcagagaatgctgagcctaagtctcgttaggtggtaaagccctctaagtgccagggagaggaagctaggccctgttctggggggcgacaggtggccagggcaggtttgcattgcggcagcagcccctcaggcttcctccctgccataagcacactaggaatctgcaatgggtgcaggaagcacgcaagcccacccaggtccctgaggtgctggccagggacctccagcaagccccagaggctccctggacctcagcttccttctcacgctgtgcggaggagtggagagagtggccctgcagacagacccccaggcggcgtggcagcccgggactgaggtcagggtgcccggcgtcaaagcacggggtccctgtttcaatgtcagagcccggccacagcgaattctgcagctccgggcatctcctcgggttccccctccgtgcagttactgtttgataaccccaaagttctgtcaaaacaaaagggagcctcaccatctatggccatgactccctgttgcttctggagaacaccccacttggccaatatgaggttcatgagttctgtgggtgcccaggaggcctggtgtgggggctgcccaggcctgagagctggggaaggtggggctagcgtggggccgggtgggggtggggggcttccgctgccaggcctggacctcacagctcacctttgtcctggtccctttgtaccacccgcagactaccatgccggggatgaagcgagactgcgggggtgctgcggccgtcctgggggccttcagagccgcaatcaagcaggtgagtgggccctgcccgccctctgcaggggcatcctgggtgtgcctcgtgggtgctcccctctcccctgtccgtcccgccacaggccccaccagggtcctacccgagtctccccagcggatgcttgtcccccctctgcccccaggctcttctggggcccccagagcttcccgccttcatcagagctgctctgggaggccccgagggcaaggtgcagccatgttctctgctcagggcctgccttggctccagagccccatgagcggttggctcaatgaggaagcctggcctagaccctcatggcatgtggcaggcagaagctcatggcaggggcacacgttgttctgcgtacccctcccgcaacccttctttgcagcagagctgcctctggtgactggtctcaccaagtcaccacctccaacccccaggcctggccaggcccccttcctctcttgcgtgggcaggtgccccaatgcttagcccttgctcagtggcagtagtcactcggggggcgtggggggggtggggggtgaccttgagtgaccttcccatggagcccagatgtccctggggccataaaaagtgcttattaaacaaatgaagaggccagctcatgctggtaatcccagaactttgggaggcggaggcaggaggatggcttgaaagccagaaattcaagactacccatagcaaccttgcaagaccccgtttctataaaaaaaaatttaaaaactagccaggcgtggtggcgcgcacctgtagtctcagctacttgggaggctgaggtggcggaggatcgattgagcccgggaggttgaggctgcagtgagctaagatcccactgctgcactgcagcctgggagatagagcgagaccctgtctaaagaaacaggccaatgaggagtgtgcattgactcatcagccgaggttttaccttcctagcctacctttctcaggccagcaacccagttccttggggtaaacttgaaatggaaaaacaaaaaggccttggcaagtagtttccaatctggagggtcctgctcctggccgtgagggaggaggaggaatcccaggaggaaggagctccttctgccggggcttcccagctggccgtgcacattccagactgtgtgacgggcttctgctaccaggcccagccggtggggacacggaggtgcggggctgaggcggcctgggcaggaggggctggcaggccctcacctgtgctctgcacgggtttggaaacggcctcttagggctcacggctgtttctctcgtgctgagcacacagctggggctgtacgcagcctgcaagccccatgcctccatgagcacctgccgtggcccgtccactgcagagcctgtcggaagaggctggaggaggagcatgtgtcctctgtgcgctactccttcactggttataaactaccaagggacacggctggcactcaaggagggtcttgactgccccagcatcataggccacggggcagggtggctctgggctcccactacctggccctcctccttgcctctgcccaggccccgtggctttggcagatgggctcaccagaagaatgctgaggcggacgggcccagctgtgcggtgctcgctgggcagctctctctgaagggagcagttgctgctctggggtggcacgggggcaggggtgggcaagtggttctggaggagccgtgtggccagccctctgtggccgtctttgccgttcacccctggttactcctccaacagagggtctgtcctgcctctgggacaggctggctgggaatgccccagcaggaagactcttctgagcttgaattccctgttcacaggaagccacttgacaaatgatcacagattcatcaggcagcagccgtgagtgttctcagcactcctccacctctagaggtgctgcggcctctagaggtggaggagcacctctagatttgaggggtgctgaggacaccccacccccactctggacaaagatccccctcccacaagagctccagcctggaggctccactgtgaacgcgaatgtcctgcttggccttcacatatccttgttggcctcttagaaaggaatacgcctctgtctgagccacagaatcaatcctcagggtaatgcatttacccagagaataaaatcagcatccacgtgtccacactggtaggaatagatcactgaaggaataaatgaatgggggagaaccgtttctcacactgaatcccagtttcaggctgcagaggtagtgatggaaacaggaagtcgtcaccccacagccaggcttcattccaggtgagagtggcccacagtgctggaactggagcatgagagtgggatgggaagaggacagtcaaatgctctcagagtgcctctcgcagctttatagtggtgacactcacaacccagcctaaccaggtgtcccagggcatgtcaccagggcagggacagagccacctgacatgcctccagaggcagtgtacagggaaggacagagcatttctgcaggattcccaccaaaaatgcatggcctgcctgtagtcacaaggacacgtcagacaaacccagcactgaaagtgccaaggccacaaaagacaaagccagactatgcagtcgcccagattaaggagggcaagcaggccaggcttgatgtgtggtctgatctgatctggacgtctgaggagcacatggaatctggatggtcccgagaggtgatggtcctgtgttggtgattactaccccctgctgcccattgtcccatggctggacaagatgctgacattggcagaatctgggtgaagggtgttgaggaattgtttgtggcttttttttttttttttttttccccgagatggtgtcttgctctgttgcccaggctggtgtgcagtggtgcgatctcggctcactgcaacgcctcccaggtttaagtgattctcctgcctcagcctccagagtagctgagattacaggcatgtgccaccacccttggctaatttttgtatttttagtagagacagggtttcaccttgttggccaggctggtcttgaactcctgacctcaagtgatccgcccacctcagcctcccaaagtgctgggattctggcatgggccactgctcctggctgtttgtgactatttctgcaatttttttgtaagtttgaaattatttcacagtgaaatgttttgaactttttagaaagaggatgtaccattcaaagatggaagggtacgccaggagctcggtggccctgggctctgggggtgttagcgaccctccaagcctggcaccaaaaaaaaaagcccctgacccacttaccaacccaaaacccttggccgccctgggggaccaggcccaagccctggcgtagcactggagacccttcccacgctgtcgctgaagcactcacagtccagccccatctttggccaccctcttctgttagaccagcaagtcccaactgtgccaggtaacacccaggaagtgtgtgaacattgacagctccagggctcacctccagctctgctgagtcttggattttttcagccgctcctggtgattggagaacacctccagactggccgtgagggccgcaagggcagggccgtgcctgtgctgtctctgtctcacgtcttccagccgtgcagacctcagcactgtttgccccaggactgcagctcgctcgtcttctaagccagcacttctcaagtggggtccccatgttgttagtaatatgggttctcagctctgccccagacctgctggatcagaaattaggggcagggcccagccttcagcgggtagcagccctccctgggaggctgaaagcatccatttgggaatcctcctcctccccgctcctccctcctccccccccgcctcctctcctcctcctcctccccccctcctccccctctcctcctcctccccacgccccagcaggctacagatccagaactctgctttctaggaggacttcagggctcccctcctttgttggtggagctcatctctgtggcgtccatggcctggagccccatggcctcatcctgtgacctcagggtcatgctgtcatttattcgttgttcctaaacacccacttctccctggaatgaccacaggaggcctcagcacagggacaggccgtggtcactgtacacacagatggaatgtcagtgctggggtatctggggaggagctctgagaggaggaggctgagggtcctgaagcccctgccccgtgtccctgacacaggctgggctgcgagagtgggagcgggggacttggggcccttgtggagctgacaggtggctccgatatcatcaccctgaggctggtggggttctttcccctgtgctgcgtgggggtgcggggccatctgtgaggctcaaggactgagcggggacccagggaggtctcagggactcgcagctgccatgcccagcaccactgctgcagctcctgccactggccactccttgccctgctggctgcccctgccccaccatcccaagtgtttgcctttggtgagggctctgcacccgtggtggaagagtcggctgttccaggagatgagaaagacgctggatcctatagagctgtgtgtccgcgctctcgaggcatgctccatgctaggaggatgtattctggttaaagattcgtctgcgggagcagaggaagggcagggacaggggtctgggagctctactccatttgacattgctgcccgggtgtggcccgcttcggggtcagggggcacccttagaacctgtgcagggcaggaactgccaccatctgttggccacacatttctcagtgaacaaatgacttttggcatcagaaagccataacttcacacctaaacttccacgaggctgagctcttcctgcccctctgtgtgtgtacgtgtgtgtgtgtgtgtattgaggggacgcggctgctggccaccttctgtcggcacaggttggcgaggcttcatgactgcccagcccatgcagtccaagagtcccacagcccagcccatgcccaggctcatccactgcggcgggtggcctctgccaggggaggctaggaaaccccagtggtgagccttggccttgggatctgccaggactgtacccgggatggcagggagggcgagctttggtccctgcaacttggagccatctctctctctcctgctgtctgtgggtctgagaacccccagctcgtcctcccccctccccaaacctatgacctacaactggagcctctgcccacttctccctccagggtttcaaagacaacctccacgctgtgttctgcttggctgagaactcggtggggcccaatgcgacaaggccagatgacatccacctgctgtactcagggaagtacgtctggccctcccactccttcctgcccactgttggaactcgcgacccttcccggcctgcaatgccagctcactccaggcatatcgggagggcactcagcgttggggtcccctgggcagcaggctccttgcttcccggagggctggggagctttggtagcaggcgcacctcacgttgaggggcccatggcacctggatgaggtgctaggctcccgtgcagtgcctggcccaggagctcgtggtctaccctgcattaccaggacaggtctttccaaaatttaggcctgaaatctttgggtgtgtgaagctctgacccccagattccctgctcggggacacctcctgcatctcccccttgagattgaccctggaaagtcaaagctgagctggcagctgaggagcaagtggctccagaattcaaaagagaagagccctctccccagccccatgagctggtgcctgagtgggcgcctccccgcatctcctgctcttcctccccatctgccgggtgccaggcacagtgtgctgaaggccagcccagccggttcatgccacccactttacagaagaagaaactgaggcatgggagagccaaatggctggtctctggctctccagagcagcggggcagggatgtcacctggaagccctttgctccaggcactgcattgctgtagggactgggggcatcccggccttcccattcagggaacgtgttggggttcggggagccacagggatgggcagctccaaatggggtctccccagtttcaaaggggctcatgccagtgtcccaggaaatcccgtccctgagcggggatctctaccatgccccaggacggtggaaatcaacaacacggatgccgagggcaggctggtgctggcagatggcgtgtcctatgcttgcaaggacctgggggccgacatcatcctggacatggccaccctgaccggggctcaggtgagtgctccctggatccaccccttagctgtagtcccagggaaccccaccccactcttgacctcaaggtggggaaggcagcgcgtgggggctgccgtcaggaagttttcataactgggcacgaggaggcaggaggagctgcccgtcaagcttggtgtgggcagtaccgaggcccaggctggatgcagagccgggaaccgcctcctgtgtgcttcatggccatggtcctttctgcctgtgttttttctttttttctcaaccgtctcttttctggctcccttatttctctgtctgcctcccggtccctcttttgccttgggtgtttctctcctgccgtcccgtccacacgcttcccgggttcctgcccgcccagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggtaggtttggagcctcgaacctggagcctgccacatgggtggagccgggcaggcggagccctgccttcagggtgctggtgcacccagggagctggggccccccagaagcagccacagtgcagacgagggcttgagaggcaggcgtcagggcacaggagtcatcccagacagcgtgggccactcactggcttccctgccacacagccaagggtttctcccccagtcttgggtctggctcagttgccccatcaggccctttgctggcttcccccttggcctatggtgggggcagactccttagctcatggtcaaggccctcccagcccagcttctgctgcctccccacacgctccctcccagccaccccgagctccttgcagacagcaatagtgacaggcgatggggcagggtggagagggcccggccggagcaacccacaggcactgtgtcctcctggcctccctaggaccgagacaacagccccagctcctgtgctggcctcttcatcgcctcacacatcggcttcgactggcccggagtctgggtccacctggacattgctgcaccggtgcatgctgtgagtgtctcccctccccactggccctggctgctcccgcccgcttgtccaaacagcgcccctctggctctggagctgctggcagagctcatcagaaacttctgtctgtgacccagcttccagcccgctgtccccaccacccccaggtctcatcctccctgggaacagagtggctgctgtgtgcgacccttccccagccagcctgtcctccataggggatcctgggccctgtctcacccatccccaccctgaggagctcccggggtgaaggcagagcacacagggccttgccccctgcctacgcctggcctgccagccctgaacgtgtccagccagcagcatggaaggctctgggctccggctggtgctcaggatctccttcctgagaaggggactgtggggcacgtggaggggacccaggaggtgaggggtccccaggaacccctcctgtgctgcagccccacgcccagagtctgtgtcctgccctttgcttgcagggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctca

SEQ ID NO: 30 - DNA, 8105 bp, Artificial Sequence
  Based on Homo sapiens sequence
actgagcagcgccatggaggactctgaagcactgggcttcgaacacatgggcctcgatccccggctccttcaggtacacgcgagggctggggagccggcttacgggctctgcggggcgcgccatcgctcttcacgccgcttaaaccgcactcctggtctcctaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcggtgggtaacgagagagctgaggggaggaaggaggcaagctccaaaagcctgggaagggcggttcccgtttgtctgaggttttctcttggccctgtacccgtgcaggccggcctgagaacctggtgctgttgtggcaaacactctgggctggagttcaggttacctggatccttgtccggccctgctaccaccaacctttgcgtaatcttcgacaaagcactttcttttctttcttacataaaaagggagcacatctatcttttctacttacagaattattgtgagaatttagcttcataactagtatatttaaagtagcttcataaacatcagagtacgttattctttttgagggtcagtgcctggggaaagaactctccactctgcattctgaggcgggcagagtgatagatgatcaaagtactgctaagtagtgttgcagcagatgggtcaggtaggctggaaggggtagagacacgtggacacagtgatgtgcactgctggctaaagtctttaattcatattcttacagacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagaggtgggtaaaagcagcaaagctgtacctgaatgaagctacacagtgttgtggggttgggtttgtgtgtggcaaaaaagagagcaaatccagggtgagatcccagctgctacattctgcctgatactgatgtcttgtccacctccagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctggtaaggcagaggtgggtgtgattcctagtggaaacatctgtgagtaggagttgggacgagagcggggtggctggaagccagttactacaattagcggcccttggagctggaatctgattggattctttcatttcagtcacttgccccggatttaccaggcttttctcatgtcagctacttttaacgaggacgtacaagcactcaaggagctgatattacataacccggtaagaggcaccatggaagtgtctggagctgcagacatgggggcactcaaagatcttgatgctccttcttaggggattctttggtgttttgggtgggacagttgtcacttagtgtctcatccctggtcctgaggcactaaaagccagtggtctaaaatcactatatatttccaagtgtccacaagggatgtctcccatttcaggccatgctttgcctaaaatcctgagcaaggacctcccctaaggggcagctttgagcagcagagccaaaattctaaggccaaggttctcatcttaagtaaactttacctttcagaaggcctgttgctgtaggccttcccttctcaatgtagtcctttattgatgtgtttctctttgttctgtgcttggaagtattttatatatggtttatatggtatactctatataccacaacaataagggcattttggggttttaggttacaaaactggaggagagttagggtgccaggaatccttaaatgcatctctgccctgcactaaaatgttgatgctttggttggtgagtaagtggccatacatctctgtgttcttttcctttctgaccacaggcctgttttctcccccaggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtctgccacagccaacatcttggttgaaataagttgaagatagagatggaaaggggacccagttaatgttctgtttcttaagcacttagtaggggccaggttctagatgtgactgatactgacttctcccaactccaaaatacctatcatggccgggcaccatggcttatgcctgctgtaatctcagcactttgggaggccgaggtgggcggatcgcctgaggtcgggagttcaagaccagcctggccagcatggtgaaaccccgtctctactaaaaatacaaaaattagctggacatggtggcaggcacctgtaatcccagctactcaggaagctgagataggagaattgcttgagcccgggaggtggaggttgcagtgagccaagatcgtgccattgcactccagcctgggcaacaggagtgaaactctgtctcaaaaaaacaaaaccctataattatttccagctgaggaaactgaggcacaatgattaagtagggaaagagattaagaagaggaaaaaggaaagggtgatggttactgtgatactagggatggcagaggggccttgagcttgctctgctgagctgattctctgtccgctcttggctgcaggtgccacatcatctcacagttcaaccaaggcttctacgactgtgtcatagcaactgatgctgaagtcctgggggccccagtcaagggcaagcgtcggggccgagggcccaaaggggacaagtgagtccatgcctctttttccatccctccccagaaatgcctgtgtttttagctttttggaagactaaaaccagagtgcacagagcagggagccaaaccttccaggcctggctggtagtgtagcccagagagccccacaggttcttgctcagctgcctggatatagagaagggagtggatggtgcacactgcacatgcaccacgaagggcaaaactgccggggttgttggcatgcagagccctgcaggggagatggcccatcctgcattggtggtatggctgtgacttgcagggagcatatttctgaagggaaaaggaaccccccaactctccagtctctgtccagctgaaggcttgactagctcagagttggttttcagatcaccatgtagggcaatgagttctgctgttgtcccagaacagaggtcaggccgagatttgggtacatgtcaaagctccaggctgccccaggaaaccctgactcctggaacggttccattgttggagagtcctctgtatgtcagggtcttatgatctacaggcatttagaggaagttttgctgattcagcgtgtgaatacgtgcccagaggagaggaagggtccggctgacattgagttatctctgcagggcctctgatccggaagcaggtgtggcccggggcatagacttccaccatgtgtctgctgtgctcaactttgatcttcccccaacccctgaggcctacatccatcgagctggcaggtagtagtgtgacggcccaggcatctgcatggtaggcacactgagggacttggggtgtgctggacagagcctgcgggttggagatgcaagctgcactgtcttcccttgcaggacagcacgcgctaacaacccaggcatagtcttaacctttgtgcttcccacggagcagttccacttaggcaagattgaggagcttctcagtggaggtaagagcctggctcttgtggtcctgggccagggtcaggcttcttccacaatgctttaaaactccatgataatgatgacagaggtcacaacatagtgtgacaggccacttccaccatccatccttgttctgccctgagtggcaggcactgtcccccttgagagataaacaaattgaggtaatttgtccaaagttgtgtttactgtctgcctcatgagcgttgagtgacctgacaggctgctgtgacagctcaggacagcacctgaccccagggtgctgggtggtcctggactgctctctgtggccgtcgtcatgggggtaccttgactcccaaggaataccatggggtactccttgggagaggagaagagagtgggtgacgggttcttgggcttggggccacacaggccacccccatccacacacggggacagatgggtcatcactgtaagaggcccaggtgcagctaacctgcatgttcggcatcccaggaaggcggtgggtcccctgctgctttcccccaagggggaggtgcaggaggcctccaatgaagaccctatcctaaggcctcagcctgtgggaccctcgctgctttcttctccacagagaacaggggccccattctgctcccctaccagttccggatggaggagatcgagggcttccgctatcgctgcagggtgagctgctgtggtggggaggggaatgagaggggaggggctgtggcccagggattgcaccgtcttgctgagcatccaggtgtgaagggaggatttggggcagcctcactgtcttgaccttcagtgtccacccccaggatgccatgcgctcagtgactaagcaggccattcgggaggcaagattgaaggagatcaaggaagagcttctgcattctgagaagcttaaggtgagtggatgggaggtgagaaggggatagatcttagacggctgccctttttggagactggctgagctccgagtggtgagaagcagagaactgggcagttttctggcctttggcacggaaggggaggaaatggacccagaatcatggaaggaagccagtctgttctgcttggtggtaaattggcacaaccttatggtggacactgtccagcagaattacgagctcatgtgtcctttcatccgaaattccacttctggaacttaatcctggtcacgcttgtgaatgtgcacagtcaagcatgtgcctgcattcatccatccatggcattatcatggaaccaaaagatggaaacagcctggggccaccatagggggcttgctaggtaaactcaggtgcattcagagccgaaggttacatgggaaggaatgaggttggttgcgtgtccatatggaacagtctgtaagatgatgcccagcaaaaaggggtacagggtactgccatgtgtgtcatggagaagggaaaatggaaacatccactcccgggaggttctgagaaatgcacagaagcagctgcctcatgccttttgaaacacatgagtgtgttatcctttgaaaagctaggtctgtgaagtcacagaagaaagatgctcactctgtggctctccctcttcccccggcagacatactttgaagacaaccctagggacctccagctgctgcggcatgacctacctttgcaccccgcagtggtgaagccccacctgggccatgttcctgactacctgggtgagtgtggcctgacagggcaggaggcagcaggctggggaagtggcattaatttctccactgctgggtcagcccctgtgcttggtgctggggatgctcaggcagaatagaacctggagaccctggcagcacgcgggcatgtaaacaggcacacccctgtgtttctaaacttgtttgcttggtcccacgggttagctgttgctgtctccattttagagatgaggaaattgaggtagtgcagggtgggtggcagacccagcatttcaggccaggtcgtctccagagctgggccaaatggccatccatgggtcgaagggagtgaacaggtttgggagagagtcacgggcaggaggcagagagagccacctgtgctgcaaaagactcaagattagcagctgctgaagaggcatctgtggagtctctgggtaagaacagtcagcagggagacagactctgtaaggcctaaaccgacaaggtagcaagagaagagccagtggtggtgcgagggatgcaggggttggcaggcatgaggtcaggaccctgggattggtttctgtagtgcagcccaggctagagctttatgtggccattaatactgggcacctctcctcatctttggcaggctctgggtaatgacttctttcagtgtctcataggaggtgtttttggtaatgagtatgtgtgacttttatgcctaaaatggattgaaggaggagagtggtggagaggaggctgtgggcagcaagtgcaggacccttcccaatgccacagggtctgctcagcctggacctgcagccacccagcgggtgtggtgttgctgctatggaggtgacaaagggtggagatggaatgttccagggcaggaaaagcctgggcactgggaaaggaaggatccagaagagatgggaacatgaaaatgccagagagagcggtgggggccgggttcccatgggacagtgagctggaggagaccccagtccaggtcctggcctgagatgtgaggaggggagttgggagggtgggtagggagggagaaggtaaggctagaactttggcctcaggaacccagtctgctcgtatagcggagtcatttgccaaggtgtggccaggaggtttagaagggccaggagaaggtggaaaggtgtcaggatgtgggatgtttgacatttgaaggggagggcccaggtgtggttggcctgggggagtccatggggtgggcgaggtgaagatagagccaagatcaggtgcagctgggatgcggggccccctgtatcggtagtaatgggccacaggtgaagaaactacctgttgacttttatttcagctgcattttctttctttaaggatgtctgtctttttctttcttgttacatgtttgttgtaacaaatctaaacaatataggagagtgatttaaatagtggaagtctaaggtgctcacattctcctggccctgtgcagatgtggtagtgaatagatgtatgtcataggctgccagttgggtcagaattggagaatttgctgcagaatcagcgggagggcagggatgggagcagtagcggtgagcccactgctcaggcaagcatctcttccagttcctcctgctctccgtggcctggtgcgccctcacaagaagcggaagaagctgtcttcctcttgtaggaaggccaaggtacggctcctggggactgcggacagccccaggactcctcccaacctgctcttttgtcatcaccagaatgtggaggcgccttgccctagggaggggaagagagggtgccctagggaggggaagagggggcaccctagaaccgggccccaaaaatctggtgtgggataggggtacttttgcagccgcctgcaggccctgcttttctttccccagctgcctttccccatttccttatctgcagcaccttctggtcgtgttggccagttgccggcacggctccctttgtgtctttctcagttgggtgggtgggtgggtggattgtctgtcggcctgattcccccaactaacctgtgactttgcctccttagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 31 - DNA, 10547 bp, Artificial Sequence
  Based on Homo sapiens sequence
acacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactgtgagtgtccagccttctgcatgcccgaaggtggggacggaagtcctgggaccccagaggttgggatgtggtgccgggtctccagggaaacaggggcccatcaggatctcaggagatgggcagcaaagcctgtcgggatgccttgaagaggggtgctggcatctgggaaggagcagaaggaaaccccagagggcagggacagcatttggggcccaggaggagggttgagtgctgtcagggtccttgtcaagccaggagggcaaatgcctgcctcctctggcatgcaggggagacacatccagggtcagggtggcacgctggggtctcccggatggcagaaggttctggtttgcaactggagtattgctgtggtgtccctctcacctaccactgcccacatccccagctcactcgtcaggacgggagtcacccagctgaaggccggcagcttcctgagaattccgtctctgcacctgctgtgagtggggcctggctgggccgacaaccagctcaagggagtgtgcgtttatgcacatgtgtgggagtgtatgctcacacagatgtcaggtgggcattgatgcacgtgtgtgggggtgtatgcacacgtctgtacaaaagcatttgtgtccatgcacatactcacacctgcgtgcccatgcccacctaggctgagggtggaggccagggttaaaatgtcagatgggggctgcaattctggaaaaatttctttcttgcccccttgccagcctcttcacctccaactccttctccgtgattgaggacgatgcatttgcgggcctgtcccacctgcagtacctgtgagtgaggccaggggatggaggcaggtgggtctgggcaaggagggacccttctgtggctcccagagtagggggagatgggagctgtggccctgaggagcaggtgtttggacatcatggtgggatggtgttgataaaaatggcgaacccaatggtgatgatgctttgggtgatactgatgaagttctcagggctggtgtcaatgatgtttatcagtgttgattatcacctcacttctctgcttcaagatctacaaagggcccggataaccagagcctgattctggctctccctgactcatagaaacccaggaagggtgtacagaagtcagagacaagaaacgtttcaaatgaccaggaaacaactctgaattaggtagtggtggtgatactgtggtggtgttgagggtggtgctgacgattgggtagtggtggtgatggtggcagcggtggcagtcacagcatgacaatgctggcattggtgtgggtcatggcgttgatgataatggcagtggtgatgaccctgttgctgctgctgacatgggattggtggcattattgatgatgatggagtggggatgatgttggtaaaaatggtagccccagtggtgatgatgctatggatgaaatcactgatgaagttcttggggctcgtgtctgtgataattatcaatgttgtgggggtgggtcattacagtattggtgttgatgttggtgatggctgtgggtaggatgttggggttggtatgaatggcaatgttgttggtactgggttggtgatgatggtgaaggtgttggtatttatggaaactccggcagtggtagtactggtggtgggtgaatatgtgcatcttgggcataatggagatgtgagtgttggcagtgttggtggcgctcatgctgatgtgtgtgatagtgctgcattggagatgcgggtggcaatctttttggtgttgatcatgaagattgtgttgttggtgatgattattagtgttgttggtgtggagtttggtaatgatgatattggtgatggtgttgatgggagtgggtggtgatgttattggtgacaatgatgctagtgttggtgatgatagtggcaaggtataatgttggggataacagcagttattggtcttggggttgatgatggtaacagacatgggtgttggggatgctggcattgggttggtcattacagatgatgctggaggtaatgtggtggtgtgggtgctagcactggtggtggtgatggtggtggcagggtatggtgttggggataatggcagttattggtcctggggttgatgacagtgataaagacatgggtgttggggatgctggcattggtgttggtcattaccaatgatgctggaggtattggtgatttgggtgtcagcactggtgatggtgattgtggtggtggcagcaggacaatgttcacagtgaaactggcaatgactatggggccagtttcatggctcctagaattgatggctgggactttgggaggagaggtttttgagaggctttccctgggattgtccgtggtattggaagagaattcagcaccttccagtgggcctatgtctttcatggggtgcgttccctgaagctcagcgggcctccccctgaccccagcttccctccacagcttcatcgaggacaatgagattggctccatctctaagaatgccctcagaggacttcgctcgcttacacacctgtgcgtgcctccaccgccccagccctccatgagaggcacccatgctccaccccccagggaacacagggtatccttgtggctgctgacggtgccttctcttcctccaccagaagcctggccaataaccatctggagaccctccccagattcctgttccgaggcctggacacccttactcatgtgtgaggctcatgggggctgggaatgtggggggttggggaatgtttgtgtcggcggggggcatccgtgcccacttctggttggcgtgcatgcatttggctgcagtggttcttacgtatttttcttaccactatggggccccatctctggggacacttgcctgaggtgggggcaggagcatggcccccagggcgtggaagccgggtcgcagcccctccctggcctcttgccccagggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaattcttcgttaagtgccaagtattgcgctaagaactgcaggtgcaatgtcacctcctttacattgactcgccttttctataaatagattttgttgccttttaggatactgggcagtgcagagagcacagaatgatgaggccagccctgggtctcgccctcaaagagttcaaagtccagaggaatgcaggcccagacaggacagcccaggacgatctgggcaggatggggaggcccagccagaggggtcagggcagggatggggaaagctgtgggagctgagggagcccagagtcagggccagggccacacagagctggggggacaggaagggcttcctgaaggagtttaagcctgaagggtctttacacagatgctcttcttttctaagagttggggtctcattctcttgcccaggctggagtgcaatggcgccatcatagctcactgcagcctcaaactcctgtgctcaagagatcctcctgcctaagcctgacaaatagctgggactacaggcatatgttactgtgcctggctaatttttttaaaaaacttttttgtagagatagggtctgggagatgctacgttgcctaggctggtcttgaacttctggcttcaagtgatcttcctacctcagcctcccaaagtgctgggattacaagcatgtgccaccacacccggccacagatgctatgaatacaataacaacagcaataattattattatctataacaatatgaaggggacctgcccctccacacctgtgggtatttctcgcaaggtggagaagagagactgagaaaagaaataagacacacagacaaagtatagaggaagaaaagtgggcccaggggactggcactcagcaagtgaggacccgcgccggcactggtccctgagttctctcagtatttattgatcactatctgtactatctcagcgagggggatgtggcaggactatagggtaatggtggggagagggtcagcaggaaaacatgtgagcaaaggactctgtgtcataaataagtttaaggaaaggtactgtgcctggatgtgcacgtaggccagatttatgtttaactttacacaaacatctcagtgcagtaaagagtagctgagcagtattgccgccagcatgtctcacctccagccataaggcggttttctatctcagtaaacagaatgtacgatcgggttttacaccgagacattccgttcccagggacgagcaggagacagatgccttcctctaatctcaactgcaaagagaccttcctctttcaccaatactcctcagcacagatcctttacaggtgtcgggctgggggacagtaaggtctttcccttcccacgaggccatatcttaggctgtctcagtgcagggaaaccttggacaatacccaggctttcttgggcagaggtccctgcggccttccacagtgcattgtgtccccggctaatcgagaatggagaatggcaatgacttttaccaagcatactgcctgcaaacacattttaacaaagcacgtcctgcatagccctaaattcattaaaccatgagtcaatatagcacatgtttctgtgagcacagggttggggctaagttcataaattaacagcatctcaaagcagaagaatttttcttagtacaaatcaaaatggagtttcttatgtcttcctttttctgcatagacacagtaacagtctgatctctcttcctttcccccacaacatgtatatataatatatatataattatatatgcatacataattattatcagcatataattattattattctaagtgtaagaaagacatgtttttggtctgtgggacacatagaagaaggggatttaacttagggagtccctcttcattcaagttatccaacaaatgttcactgaagtccactcagtgcccagccctgtgagaggtgatggtcactgtggttgcgacctgagccgtggccttacgggacttacagtcctgggagtttggggagatggacatttaacaaacacggcacagatcaatgtgtgctatacgttgtgataactacaaggagtgatgagagaatgagggttcctatgggagtcagagaaggcttctctcaagtggggatgttaggtctcgatgtggctaagtgaggaacagagggaagggctcttcagagagagggaacagcctggccggtggccctgaggcagcatacagtgtgccctgtttgaagatcaaacgaaggcaggtgtggctcaggggtagtgagtggagggacaggtatggattttggaagccacagagaggagaggagactttattctgggccatggcaagaatagaaagttttttgtatgtttgtttgtttatttgaaacaggatctcactctgtcgcccaggctggagttcagtggtacaatcacggctcactgaggccttgacctccccaggctcaggtgatcctcctgccccagcctccctggtagctggggctacaggtgcaccaccaccatgcctgctaattttttgtattttttgtagagatggggttttcaccatgttgtccaggctgctctcgaactcctgggctctactgatccatctgccttggcttcccaaaatgtggggattacaggcgtgagccaccactctcggctgagagttttgagcaagaggtgatttgatagccatttaaaaaagattcgccctttaggtgggcattatatgtagtttggctcattgcttcaacgctggcacctggaaacagggcctggcacgcagagtgaaatattacagcctggagtcaactgcccagctcccctactaacaagcggagcagccttggtgccccagtgacaatgaaagccaagccgctgtcacaaactctcaaaataccatgaattaaggatagaaggatctggagtgagctgtccaggtacgtggggcagtccctgggcattgtccttgctttcaggcttgaaaccaggttgtggcacacccacgtggtgggaaaggagaccaagttgggacaagctgtttccaggtgtggtggctcattacactcatcacatctgcccttgttccactggttactcagtctcaaaacagccacatctaactttcagcgagggcggtgaatgggggtcccgggataatgcagcctctagctgggtggcctggtgaccagctccaatcctctctcctggaaggtgggaaggatggattttgttggataacagactgcctgtgccagttagcctttgttttctcatctgcgaaggggaaatcatcacagaatgtacctcacagggatgttgtgaagttaaatgaattaatccagatgctgtttctaagggattatttggtgatgccacacagcttagaaaataagatttatgggccgggcacggtgcctcacgcttgtaatcccagcactttgggaggccgaggcgggcagattatgaggtcaggagttcgagacaagcctggccaacatggtgaaaccccatctctactaaaaatacaaaaattagctgggcgtggtagcgggcgcctgtaattccagctactcgggaggctgaggaagtagaattgtttgaacccaggaggtggaggtggctcatgtctgtaatcccagcactttgggaggtcaaggcaggaggatctcttgagcctaggaattccagaccaacctgggcaacatagcaagactccatctctgcaaaaaataaaaaaatagccagccatggtagcacacacctgtagtctcagcttaagaggctgaggaaggaggattgcttgagcctagaaggtggaggctgcattgagctatgattgtgccactgcacttcagcctgggagacacagtgggaccctgtctcaaaacaaaacaaaatacccctcgacccaaaccaaacaaacatctacagatcaagattccagttatatgtccctatgaggggggtaccatgaatggcctccatttcagagatgtaggcaaactgaggctcagcaatgaggaccctgggggtcctggggcctgcctgactctcttctccacccacagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccggtgagccccctccccgtccttctgcctgtccagcagcctgcctggctggcctgacctgcctccccacctccccacagcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtgaggctgggcctgggggcggggggctggcttttcagcactgacccaatcttgcacactaagcctctaaactctgacctaccctcacatgccgacctttgaaccaggaccccaccccacactgatgccaagactctgaccccctcaaggctggctgactccgaaccactccccagtccccgacactgatgctggccccaacatcctgattctacccccaaatgctggctctgtgactcggatgcattccagacttcaccacagccacacctgtccccaccctgacactgagcccccaaggctgatgctagggttaagcactgcccactgtttctggagtgaggtgcaggcaggggagggttctgagtctggaagggccctgatctgactcaggtgttcacaaggtctctgggtggggaacagactgggggagcagggagaggagcctagaggccagggaagaggctgccaggatggtccagtcaggaggggatggagttcagccagaggtggtgggagaaatgtacaactgtagaaggtgaaactgacagagtccatggctgagtgcttctgtgtggggcgtgagggcaagggaagggctcagaacaactgcatgtgtgtggccgaacaggtgggtggtgacttttatgaagataagaaagctatgggagttttgggaccgacaggcttctgcttccaagctgttccacggcccccagagacccccgggaccccaggccctcactggccacacccccacaggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 32 - DNA, 5813 bp, Artificial Sequence
  Based on Homo sapiens sequence
gattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccaggtaggtctcttggcatcttccagacagctccagtgaacttcagacccccgattcctttggggttatgcctggagatattttgggttcccttgctgacacaccactccccagattccccaccgcctcacccttctctggcccccaaatcctccccatctgctgcaagaccttggtctcctgcaggccaccactgctcccattcccccaccttcgtcctctggtctcttaagtctccccacccacccagatccttgaccccccatagaacccaagagagagccaagctcctgaacttgcctggtagctggattccaggaaggaattcgagagggattgtagggggaggagggggcagtgagtggagacttgggagtcagaatctgaagtagtttggaacaggggcagggctaaggtgtggagctcgcggagcctggcctccaggttcaatcagagggccatcgccactgcagctccctccatctctccaccccctcccccccaccgcctcgtggctgtgtccacatctggaagtagttaggcggctcctgtccctggactgccaggcagagtgaggcgggagtctggaaggggggccgaggaggattccgggaattcctgttggggtgggggtggggactcttggggttggagggatggtcgagttgccaggcccacttttcccttatctttgtgggagtctgggacaccccagccctgtcctggctggtggaagctgccccaggtctctcaaggcctttccatttcatcccccagcttccctccttggagtttcatcctcatcacctcatccccatcttgccagtgctcccccgtcccacccgtccctgctctttcctgaccccttttctgttctccagacccgtgttcctgtgcggaggggatgtgaagggggaatcaggttacgtggcaagtgaggggttccccaacctctacccccctaataaggagtgcatctggaccataacggtgagaaacccctctgggcactaccccttgttaaagtctcagaggcaaaaaggcctgactgcgaagggaccccccccccgtcccccccgcaccaccttctcaacctggggcagctccaagtgtcttccctctgtcactgaaggcatcattcccaccgtaacacgcatcatcttaacccttccctcaaatcttcattctccagtccccggccctccctcctcttccaaagcctcagctcttgtcccctgcacaggctaccagcagagctgcagagaccaggccctctgctctgcactcacatggaggccccttcccattcagtccgtttctgcaagaaacgcttggggcaggggagctgccctctggctgggttgtgtggggcctgactctgtgggtccccgcctctgtccccgctatcaggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactggtgagaactccctcacctccgccttccccccctccaggccccgccccggccgcagccccgcccccagccctaacctccgccccgcccaccccgcgccccagtgcctagggccccctacctccctgacccattttcctcactaaccgccccttcagtccctcctccccgtcttctctcccctcctcccgcacccacccatccctcttccagggccccccccaggcgcgaggcggaaatgggtcaccgacccgcgggtggaatgggcggcctggggttactgggacggtgagtaactgccggcccccgtccgcaatcgggctccctccgtcgggcgcgagggggcaccccagggctggggggactaggttcctccaaccccggggggcccctacacccagccctgggctcccgattgcggtcccatcaccccctcctggcggcagaagtctcccttgcaatgtttcaggcggggacctccctaaaggggtcctcgggggctgtgccccaagtcgaggacaccctctccagcctgaaaggggactctgctgcagggccggggagatgggatctcctaggggaagaggcgcggtgcggccgcgggtcggggaggggccagaagggggcgtccagccagttcctcctcccgcttccaccgcccgccagtgcgccctgcggccccagacttccccgagccgcgctcctcccggccgctctctgttaacctgcccccatcttacctccccttcttctcgtcccctcatcctgagccccagacatccgagctgcctgccggggctcccagcctagagttctcctgaagctgaccgagggtctccaccgccccccacccccgctcctctctcccctccccagagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgtttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtcaaggctgcagtaagcctagatggagccactgcactcaagcctgggagacaaagtgagaccctgtctcaaacaaacaaaaaaggtcatggggctgagaagagtgtggtgcacgcccgccctgacacttcccccaatgctcggtggccacctgcagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctggtgagtctgggataggggaggaaggggaaacagactgaagggggccatttcaaaaagttctgacctgggctgtggctcacacctgtaatcccagcattttgggaggtccagacagcaggatcgcttaagcctaggagtttaccatagcaagaccctgtcttttcaaaaataaaaaattaggctgggctggtggctcacgcctgtaatcccagcactttgggaggccaaggcaggcagatcacctgaggtcaggagttcaagaccaccccggctaacatggcaacaccacatctctactaaaaatacaaaaattagccaggtgtggtggtacacacctgtaatcccagctactcgggaggctgaggcaggagagtcgcttgaacctgggaggtggagattgtagtgagccgagattgtgccactgcactccaacttgggttacagagtgagattctgtctcaaaaaaaaaaaaaaaacttagccaggcgtgtggtcatagctactccggaggctgaggtgggaggattgcttgagctgggaaggtcgaggcttcagtgagccatgactgtgccgctacactccagcctgggcaacagagcaaaactccatcttaaacaaacaaaaaagttcttccttggctacattcactcattgattcatctggtactcactggtgcctccttcctgccgatgacccctactgggtgctaggaccggaagcctgacagagctctgaacagttcaagtcaatgaggctgttatggggacagtgctccctcctacctgctgagcaggtcaccctccaccctcctccctcctagatgcacccacctgcccaaagcagtgccgccggacaggcaccttgcagagcaacttctgtgccagcagccttggtaagaatacccccaaccccattccagctcctcgaaccacctcctgcttctgtttccagtcctgccatctggaacctcccatctcctcatctctcactcccattctcccacagtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggtaacagagatgtggggaaatggggatgggtcaagctaagccacacagaaatgatcaaggtgtggaatcttgagacctgctgacaggtctcaagaataagagatctcaacccctccctccttcttccaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaa

SEQ ID NO: 33 - DNA, 8808 bp, Artificial Sequence
  Based on Homo sapiens sequence
agtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagccttttttttttttttttttttttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggtaagtggggtttgcagcctactccaccgcccgctgtgcctcccggggcgggagacaggggcgccggccgctgcgcgcccggggctcccctcctcctccctcccctcccccacccacgtggctctagtggcctccgcccgagatcggatcctacctgaggcgggagccctgggcttggtcacttcccaccttccagatgtattaaaataccggaggaggagttagcctttctggatgtcctcattatctaacaacccctccctttgatttttaaatcctcacaggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtaggtgtgcaaaaaagtcgggggacctaacagtctgcagaatcgggattggccggctcctgggatcttggcaagccctgaagtcccccgccttttctgtgggccactcttgaggagttttgaactcctttggtgttaactttgggtggtgggcagcgctgggatgtaacagacctttgcagtgaaaggcagtcggtttcagctgggaaatccgcgcctctaccccggtttacaggttaagtagatttttaattattattattttttgggaccgagtctcgctctgtcgccaagctggagtgcagtggcgtgatctctcctcactgcagcctccgcctcgcgggttcaagagattctcgtgcctcagcctcccaagtagctgggactacaggcgtgtgccaccacgcccagctaagttttgtatttttagcagagacggggtttcagagtgttgcccaggctggtctccaactcctgacctcaagtgatccgcgcgccccaacctcccaaagtgctgggattacaggcgtgagccaccacgcccggcatagatttttagttctattctgagtcagtgagtctttttaggagactggtatagtccatattttttcttttttataagttgttttctctagtgtagttgccactcagttgtttcccaccccttctccatttttaatgacttgaaatcctggccagtattttacatatgttatttagaaatgtggacataaatgaaaattataggtaaaggatttagcatattctgtgatatgtcaaatttgtacttggaaaaagagggaaactttacagtatctggaaggctcattctccaaaatgatttcttgtgtcttctgctgtaaggtggatgttgcgcaaaaaccaaagggatacacagaaaatgtttggcagaaaggcatctacaataccttcatccaaaagagtcagttggcggataggtggctttaaaaaatactagaactttttttttaaaaaatagattgcttttagaaatttaccaaatttttatcttaggaagataaaagggcagaaaaggatcttaaaaacagaatttggaagcttttgagatcaataaaattgtaataatttatcattaactgcagggaaagtggtggagattgatgttggcctaataagtagaatcttagaagtattggaaagcactgagagtaggagcttagagctccttggtgttaccttgcaggcttacaacatcttcaggaagtgaggtaaagtgtcatcaaagcaggaagtgagagtcaggacttagacattttcttctcatacactgactcatgacagtaatttaaacttccacatctttaaaaaacaaaagagaattccttcttagggaagtatggtgaggattgattagtataattggagtttttggctccccaaatatttttcacccaatgattgaaagtattttttacgctaaaaacggcatcttatttcaagtatttcatgttctgtagtgacagtcataggtgtttccatcaaaaaaattattggaaaattaaacttattagttaggtactatagaattttaaggggaacaattacctgggagtacaatttaaacgaaaattaaaaactatagaaactctatttactacttcagtatgaccttgagaagttactacacctcatacttcagcttcctcttctgtgaaatgggaataattataccttatttaccaaaacaacacactcagcttggagtctggctcattctaaggcccttaaattctggttgaatctaagaaaagtagcttttgaagaaaaacatacctaacatctaaataatggttcaaatatcaacatgtttatcagaataccctgaaaacttacctcagtgttctcatttcttaaagtgaatgttaaatattttaattgtaaccaaattttttctcaaaatatgggttaatttttattttagtaaggtgaaatgttaatgcactgtatcctaagccactctttgtataacttaagagtggtgaatggtgtctttaataaataaccctttaattaaagtaaagagaactgtatagtaagttaaagtcatgaagttaccatagtagttgtacagagaaccattgagaaccaaaccttggattgattttataatattaatttacctttttcttagatatctaggattattttatgtagtgatgctgtctgctttcaaaattgttcggagtaaacatttgccagtttgtttactacaaacccagcatggtattaaaaatcacatgtttggaaaggcagataggtgaagctttgtgaccttagtgttttttttagcactttgaaattctaccagatcttcggtagcttaggaatcctgtgtcttttatggaggcagaaggaaaactgttatatcattatttgactagactgtaaatgaaacattaggatgattttacatatcttgtggctgaaaaatagtttctgtttaaatttctgcaattaaaagcttttgttttgttaattgactaaagatgtgatcattgggtataataatactggctttgcgaaaagacttattttccagaatttgttatgatttagataattatgtcaaaattcgacagaatttttgtattcttttgtaaatagcaagttatcaaagttagatttattgtatttgatttactatggtggatagagagggcttgatcctcacttctaccttaatacaaaaaatatatagtgtgaagatttacttgatttaaatagaagaaaataaatatatttctaaagaattaatgtttcttttctctctaggtatgcatccatgtggaaaggatgtctgacactttatactggaaggggtggtgaacttcaaaaaattggggagtaagtattaaaatgcattttgtataattgcatatattataaataatatctacggaatgattggtaggtatgaattgtaaacctctttggcttttttgactagtaaactgaatgtctttggtagcttaattgaaaaaataacttcgtgtatacaaatttaacacttgtcagtactgttttctgtggttaaaagtgtcaatttttcctggcaaagagcagtagaagaagctgcagttgagaccagccctagtggaagcatttctgtaggttttagaaatgtgcattttttaggtgtcacaagagccatttgaagtagattctcttttgtagtgattcaccatatacgaagctagtgattcaccaagtttcaggccataagtttaaattttctttttctatggttatgggtgaatatgtactcatgttaaaaaggacttgcagcaacgaaaactgaagtcctctatttatccacagtctaggtgcggtgcaggcagccgcaatgcgagattccatacactactaccctggtaatgatctccaccctgacctggaggagccatcctctctaggggtgtaaggtaattcagcctccatgttagcctagacattgggttgtattcataaagtatggtacaggcaatgagccaaatcatcagtccattctgtttggttaatgctctgccatctacttaatgcctgtcaaattggaagatatttaaaaagagaagccacaaatggcaccagataaaaaaggaaaactgtttgccactgagggaataagatgcttatttggagaacctgtggttaataatgaaggaaaagaaatgatcatgctagcttttaaagatcagaaacacttaacgctttgcctttgttagaagggaagttaggattcacttagagtagcattaatagagttatgtgttatgaaaggtcttagtgtctgttactgaaaggttcaggattctgtcctgaccttcatgtattcatacagaggtgttgataataatggaggtcagttacgtgaaaaaccgttagaggtcactcatttcttaatgactgctctttgtcagggtcagtcgaggatttaccaaaactggttctgatttgtcttcagtatggtgaggagtaataaaatgcttctttgtaatgttagtacacattatatggtcaacttacaggaagcacttggataaactggtggctatgtagcctgttgttattatttattgcctagaaaccactcttaaccctaaatgattatctttgcagatccacagtgatcgatcaaaagagggactgaatgggagtgggtgaatggatcggtgcaaatccattaccactgctggagaaaccaccctggaaccctaaacatggttcactctcatgttatttttcctttgatcagcttttgtggaaaaacaggacagagatgtttttgtgtccttgatttttgatgtgatttttttttcagcactaaagaagaatttaaatacaaaatagaatgttatatatcttgtagacagtcaaatatttgatgttttatgggacataatcatttgggaagtttttgttgtaaatgaagagttagtttgttgctattaatttgtttgacacataagttcattcctaaaagttagagatgttacataaagaagggttgaggactttatttcagaagtcatttaattttttctttattttctttcagattttgtatggtttattcagaagtgccaaatttcagtgaacccaacccagattatcgaggacagcagaacaaaggggtaattgtgtagtatacttttatgattaggctaattttgactgtgttataattctatgattaggctagccctgttgatacttagtataaagaagataatttttaaaaggatacttaatttttattgtatgttttgtgaggatatgtatctgaggtgtcatctactagatatatgtgccattttgcactttgtggtgtgctgagtaattatcaggaaataggatgtaacagagctctgaaaggtttgggaaacgtttcttaacattataacctttaatgacctaggaaaaatctttaaaaaatttgttaattaaaaaaaaaaaaaaagccaaacccaaaactttaaaaaagaaaggatataataatgttgtaataatataattgtgtttttattctcgtttggttaaattaaaaacttttttttaggcacagagtgaacagaagaataattccatgaatagtaatatgggtacaggtacatttggaccagtgggtaagattttgtttgtgtgtttcatttgtgatcaggtataagaatgaagagagctgtaaagattcacgtgaaaagcaacgtctttaggcataaattagtgataaaggtgaactaccagtaaacagggaatccccaaagggctgattttctagaaagttgataaacttaagccagtttattgagaattctaagtttttgtgatgtccgtgaagagataccatgctattttttttttattgattcctataaaatttctataatctagtgattacttatagtagatgcagaattactggttattttggtgcactgaaagcgttttatctttagagtcatagttcaccttaatttttcacatacaagtagctgctgctttaaaagatgagctgagccgtttaaaggctagtgaccctcagatgtcatttaacatgacccccagacatcatgttcatgatccttgtagctctgttaaaggtcttctgaagtcttttttcttaaatatatgaggaaaagtcagtcttttgtgattagagttcattaggatggctcatgttttggttttgttttgtttttgagacagggtcttacgctgttgcccagactggagtgcagtggcgtgatcttggctcatcgcaacctccacctcgcaggctcaagtgattctcctgcctcagcctcccaagtagctgggattacagatgtgcaccactaccacccagctaatttttatatttttaatagagatgggatttcaccatatgggccaggctagtctcgaactcctgacctcaaatgatccacctgcctcggcgtcctaaagtgctgggattacatacaggcgtgagccactgaacctggccagctcatgttttatttgactcgaaggctacatgtcttggcattgctgatcacattgtgggaaacgctgcctttgcctttaaaaagttagaataacattgtctgttttgagatattaatcatatttgagccaaattccaatattcactattttgccctttctttttcttttatagtgtaggcaatgcatttttttactctattaatttctaattttgatgcccaagttggcttttttctctctattaatacagcatcaagttagcatatttatagcaatacatttggaaaaacttagagcccacattgttttttttttctgtataaaaataaaagtgtgtgctttaatatttttaagcattaataacatgttggcacttaagatagttctacttctatagactacctctgaaaatagtgatgaatttttgtattcttttttaggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaaccta

SEQ ID NO: 34 - DNA, 10874 bp, Artificial Sequence
  Based on Homo sapiens sequence
gaattaaggctggaactggagagggaggggtctgcggtcagtcggacgcggcgctggaaatccggcggaggacctagaagtagcgggagcgatctgtgggcggggcgaacggcctgccggccgacggtagggcctgaagagcctagggtggggctcgcggtgtcgcggagggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtatcacctacctcccttcgcgtgctaactgctccctttgcaatccccatcagggctcactagccccagtctctctgaaagggtgaattagctttcacacgtggcagttatatggttcggtcttcgtcctgctgctttggagtaccatgtcagtctcccctctgcagcatcttttactcagctgggtagtttcctccatatcacgggcttgagcaattactggtgactcttggatctataatatagctagtacagacttccttttttagcttcagacccacgtatcccactgcctgcttggcatttccacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaattcataattctaaatatccatcctctcttgtttattagcattgttgttctggtccaggccttcatcaataaagcaattgcagcagcttactagtaggccactttgcctcatttgagacagaatttttccattatacatacctgaacacataactcttgcctacagctatggttcacaaactttactatgcataaaaatcccttggggtgctttttgtcatccagtccagggactgattctgatttcagtagggtgggagggaacccaggaatctgtatttttaataaacatttcagttggttccagtaggagaccagtctgagaaacaataaagtccaaacttatcacagcacccaaggaacaagctgttaattcaactacctacagactcttaaaaaaatgtgtgctgctcctgctcatgtctacttacctcatagcatgtatctttaccttgctattacatctgcctagtgagctcctgctcattcagctaaagtattacttcctctgtgaagaaacattttctgacttcctgccagtgtcagacctctgaatcccctctacaccttgtacaatacttctgtttaagtacttatctatcatactgtaattaacggtattctcatctggctcattaatagatttgaagttcctagaggtttgagaccacaccttcttcaagattatgtcccaagagcatgtccctggatgtaaaagttgaatttcaccaaagtactagggattcaataagtgtttgttgaggctgggtgcggtggctcacgctggtaatcccagcactttgggaggccaaggcgggtggatcacctgcagtcaggagttcgagaccagcctggccaacatggagaaaccccgtctctactaaaaatacaaaaattagctgggcgtggtggcacgcacctgtagtcccagctactcgggaggctgaggcaggagaatcgcttgaacctgggaagcggagcttataatgagccgagattgtgccactgcactctagcctgggtaacagagcaagactctgtctcaaaaataataataagtgtttgttgaatgaatagaagaataatgtttattgtaggcctatggtatgaagtactgtgtgatataatagacaaggtaatcctggctgctaccctctaagagatcacaatctagttgggtaatcaggagatatgtaagtaaaactccctccattgtaagttggggattttgcattttacttccttctgtcatgtgcgttgttcaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggtgagtaccctcttctctgtctggtcctaaatggctgatgaattcaagtgatcacagggtaggtttttaaagaggataatttatttgagctccttaatactggggaaaacattattgtaccctgaactcagattttcagccactgctttggcttaataacctgtatcatataattttattagagggagtttttgattctcactctaagtaaaatagtcctcagttttggttaaatatctctaaacaattatgtgtatatctttttttgctgcctgtgcatcattattccaaatgaaaagtcaaattaggctgggcacagtggctcatgcctgtagacccagcactttgggaggcttagacaggaagattgcttgagcccaggaatttgagaccagctgggcaagatggtgagagcctatatctacaaaaaattaaatgggcatggtgacacgcacctgtagtctcagctactaggaaggctgaggcaggaggatggcttgggcccgggaattcaaggcagcagtgagctatgatcgggccactgggtgacaaagtgagaccccatcttgaaaaaaacaagaaaaaaacagaaaagtcaaattatggctttttaagcttgatagaggctttctgcaattcttcatgatctgatgggtgcagcatctactaaaccatctgttaggtgaacaggggctgaggtatgtcaaaattagtatttcagaatctggctaactccaggatgtgttgcttaggatgcctggtgtgcaggagtatatacaacagcctattctcaatggtctgcgggataaggcttcatatgtcaggagagtggcagtccttggatgtgccaagatgcataatcttcatggagactctgaagtaggtaagttcagtgtaatccatcatggtcaatgtgcctccattatgtataactttaaaaaagattgtgtggctttggtagaaaataataatgtggccccagttctgtacatatctctttaagtaggatgcagggcttggtatcttctggagatgagaagtcctttctctggggccccaatgagatcctttgtattagctgcttagaacagtctggacatggcagttttttttttgccttgcactttagtgtggcctttgtcatttttgtagcagagaagttcaactttgtctacctggagctattactctggctacatccttgttactctgaagctttccttctttatctaagaactttgttcttttttatagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcggtttggatgcctcagcactctttttattatgagatctgctaccttgtgggatcttgttgatgtattaaagtattgaacaacttatgtggggtagaaaagaaagttaaccattattattattattatttgagacggagttttgctcttgttgtctaagctggagtgcaatggcgctatctcggcttaccgcaacctccgcctcctgggttcaagcaattctcctgcctcagcctcccgagtagctgggattataggcatgcgccaccatgcccggctaattttgtatttttagtagagacagggtttcaccatgttggtcaggctggtcccaaacttctgacctcaggtgatccgcccgcctcagcctcccaaagtgctgggattacagacgtgagccactgcgcccggccagttaaccactattaactccctcacattccactgagagaatttcttttatttgccttactttcccttattgatatagggaaatagaaatatactgtgggaataggttctacccttctctagtcatgtcccccaaactaagccatttatagtgtcttaaaatgtaaggaacctggacccagtgtatgctgatcatgtctttggtcttagaggagtgtgcatttgtattaacaactcatcttggaattttaagccttttttgtgtaaactttaaatagtacatgaaaagtgacttaattatggcacagcctatttttaagaattctccctttgctatgatgaacaaccacctggtcatatggcagtggcatggaaatggtcctaattttgttgctaaaatagctcttttgttttgttttttggatagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtaggtgtctgctccttttccttcttgagaacctagaccagccagcaagaaaactgtggttagaggaaccatagagagcaaagggcatgaatcttgcttcagaagcaaagtactatgcactaaataattgggtcagtgactacaaacacgggggaagagagtttttttttgttttttgtttttttttggtcaagattggtgttgctgtatcttccaggatggagaatacaggtaacacaaactacaatacttaaaattgttgttgtcttctatccaaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctggaatttgaaaggctggagtgactcaaaaactgaaaacagctgttgagccaagttttgaaggatttcaagtacaggaggaggagcaaccctcatatttggaataaagcatggttattttaggggcagagaagagggagcaaagaggagacaagaaatccttaggagactgctgtcaagtgtcccccacaaaaatactccattgcaggtgtgctgcaacaaaaagggtacctcatatctggctgccatgtaaatacctttgttactataagttttcaaccttgtttaatggggaattgttttgctatgagctttcagttttctagtagtcagtgagaaaaaatgatttttaccaaagttccctttatagtaaacttatattcttagttcatcaagtaaggagtgaatttttttcttttttttttttttagataattctgtttcttttgtctttcactggtgggagatgattttagattgaggtgctaatatttcacttagcagttttctctgctttcccttcttttgtaggtggcattgccaggacttacacagatcaatgtgttcagattttaacagagttgctgggtcttcgacaagagcacattaccacaggtaatgcctgcctttttaggatttttgttttttttgtcaggtgcctggcctatagtagttgctcaaaacatgtttgttgttgaatgagtaatatagagatttgaacttttccttgcatcatcatctgttgctgttagagaagcataaagtctatagatctaataggatattgagtcttcaggctgccatgatctataaggctgtactatagataatgaaggctactaggatgaccttgcttgatatttcaccatctttacttctctttttgttttatggcagtatgccataggcagtggcttccagggttgggacaagggtaagtcaagcaagatgcctaggatgcaaaatttaagaaggcactcactcttaggttcctgcaagagccaatcctgcatgtcttcttcaattttgaaccctaggcacctcacttgtgttatcattttcccaggcctggtggttctatttatactgtctttagtgtttcattcaacagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagatttatccgacgggttttattacaaaactgtgataccattgttctcttgaacagttctgttttgttttgttttgctttgcttgagatagagttgcccaggctggagtgcagtggcgtgatctcggcccactgcaacctctacctcccaaactcaagtgattctcttgcctcagcctcctgagtagagtagctgtgattacaggtgtgcaccaccacgcccagctaatttttgtatttttagtagagagggttttgctatgttgtctaggctggtctagaattcctagcctcaagtgatcacccacctcagcatcccagagagctaggattacaggcataagccactgtgccccgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataactttttttttttttttgaaacagagtctagctctgttgcccaggctggagtgcagtaatgccatcttagctcactgcaacttccgcctcctggtttcaagcaattctcctgcctcaggctcccgagtagctggaactacaggtgtgcaccaccacgcctggctaatttttgtatttttaatagagacgggtttcaccatattggccaggctggtctcgaactcctgacctcaggtgatccaccctcctcggcctcccaaagtgctgggattacagacgtaagccaccgtgcccggctgacagatacatttttaagaagcttcacagatgactctgatgtgcactctaggttagtaaccatttttgtgaaaaatttagagaaattctttgagcagcttccactgaaacactaaaacccaatagggccaaaggccccaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcataggtgggtttttcagaaggaaatagtatttgccatgacccatagtaaaaattcttaatagctttcattgtttggtgagtcacgtctgggacccgagaagaaaatgtgaatgcttcctaggttttcctctctccttcatttttttctcctattatggttggcacaagagtaggaggaaagtggttttgtttttaatgaagtcaatctgttgtcttacctcagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaactgataggggtcatcatttgtgggggtcatcttttcttccctggattattatagtaaattcctaactgttctcatatttccaatcatgcttttaggccagattccaaagtccttaatgtcatctaaagtacctctttggtgtcaagtcttgccactcccaaaatgacttcttttctggcagaagcaaaccatttgcattgcagttccctttatacacctgcttctttcacctctgtgttaacttaaacctgcttttatttattgcctggaacattttctcaccctcatatcttcttgaattaacacctcgtctatctttcagtgttcagctcactcataagctccttcaggaagtttcctttaaccctcactgccttcattaggggcctccctcaagctatcaaagtagccagagcatacctctagcagtagtattgtaattgttttcttgttgcttgtcctcaatttttattctgttcttatctgaccacattttgtacattgaagcaacttatggcaagaacaaatctaataaaatgatggtaaaatataaa

SEQ ID NO: 35 - DNA, 39852 bp, Artificial Sequence
  Based on Homo sapiens sequence
gatcacctcaacagaggcagaaaaagcatttgacaaagtccaacaccattttaagataaaacacttaacaggactagaagggaacgtcttcaactcaatcaagggcacctatgaaaaacccacagctgacatcacacttaatggtaaagactggtgctttccctgtaagatcagaaagatgaggacatccattctcaccacttctattcaatactgtattggaggttctaaccagggcaattaggtaagaaaaagaaataaagtgcatctagattggaaaggagaagtaaaactaactctatttgcagatgactgatgttgtacaaagaaacccctaagaaatccactaaaaactaggttgggcacggtggctcatgcctgtaatcccagcactttgggaggccgaggcgggtggatcatgagcaggagattgagaccatcctagctaacatggtgaaaccccatctctactaaaaatacaaaaaattagctgcgcgtggtggcgggcacctgtagtcccagctacttgggaggctgaggcaggagaatggcgtgaacctgggaggtggaggttgcagtgagccgagattgcaccactgcactccagccagggcgacagagtgagactctgtctcaaaaaaaaaaaaaaaaaaaaaaaatccactaaaaactattagaactaataaacattattttatgtttttatttttattttattttatttatttattttttgagatggaatctcgctgtgtctcccaggcacagtgcagtggtgcgatctcagctcactgcaacctccgcctcccgggttcacgccattctcctgcctcagcctcccaagtagctgggactacaggtgcccgccaccacacctggctaattttttgtatttttagtagagacggggtttcaccatgttagccaggatggtctggatctcctgacctcgtgatctcccgcctcagcctcccaaagtgttgggattacaggcatgagccactgcgcccagccttatgtttttattttttagagacagggtcttgctctgtcactcatgctggagtgcatggtaggatcatagctcactgcaacctcaacctcataggctcaagccatcctcttacctcagcctcctgcgtagcggggactacaggcacttgccgccacacctggctaacttgtttcttttatacagacagggtctcactatgttgcccatgctggtctcaaactcttggactgaagcaatcctcccaccttcacctcctaaagtgtttggattacaggtatgagctataatgcctagccatagctgaaatattattaaaattatgaaatattaaaaacaaatagttcagtgaggttgtagggtataatatcaatatattggctgagcacagtggctcatgcctataatcccagcactttgggaagctgaggcaggaggactgcttgagcccaggagtttgagaccagcctgggcaacatggtgaaaccctgtctctacaaaaaatacaaaaattagctgggcatagtggcacatgcctgtagtcccagctacttgggaggctgaggtgggaggattacctgagcccaggaggttggaggctgtagtgagtcatgatggtgccactgcactccagcctaggcaacagagtgagaccctatttcaagaataaaaaaaaaaagtatttttatacacatgcaaaaaaaatccaaaaatatcaagaaaacaattccattcataatagtaacagaaagaataaaatacttataaataatcttaacaggccgggcctggtggctcatgcctgtaatcccagcactttgggaggctgaggtgggtggatcccccaaggtcaggagttcaagaccagcctcgccaacatggtgaaaccctgtctaccaaaaatacaaaaaattagctgggcgtggtggtgcgtgcctgtaatcccagctactcaggaggctgagacaggagaattgcctgaacccaggaggcggaggttgcagtgagccaagatggcaccactgcattccagcctgggcaacaagagcaaaactctgtctcaaaaaaaaaaaaatcttaacaataaagaacaaagcttacaccctgaaaactacaaaacctttgaaagaaattaattcatttactagatctcagtaaatgaaaagacatcccatattcatggattagaagacttaatagctatggtcaactgactttcaacaaagatgccaagatcattcaatggggggaaaacagtctctttcatttctttttcaaatggtgccggaacaacttaatatctagatgcaaaaaataaagttagaaccttacctcatacgatataaataaattaactcaaatggaacaaagacctaactgcaaaagctaaaaccataaaattcttagaagaaaacacaggggtaaatcttcgtgaccttggatttatcaatagattcttagttatgacacccaaagcataagcaataaaagaaaattggactttataaaaattaaaactattgtgctacaaaggacacatcaagaaggtgaaaaaacccacagaatgggtgaaaatatttgtaactcatatcaaatatgggactttacaaaaagaactctacaaaagacaacacaattaaaaaatgcacaaagaacttgaatagacatttctccaaagatacaaaaatggccaaccagcccatgaaaagatgccattagtcagttatcagggctacgcaaatcaaaaccacaatgagatactacttcccacccactaggatgactagatcaaaaagtcagaaaatgccgggcgcggtggctcatgcctgtaatcccaccactttaggaggccaagacagggggatcacctgaggtcgggagttcgcgatcagactgaccaacatggagaaaccccgtctctactaaaaatacaaaattagccaggcgtggtggcacatgcctgtaatcccagctaggagaattgcttggacccgggaggcagaggttgtggtgagccgagatcgcgccattgcactccagcctgggcaagaagagcgaatctctgtctcaaaaaaaaaaaaaaaaaaaagtcagaaactaagtgttggtgagtatgtgaagaaatcaggacccttatatgttgctggtggaaatgtaaaatggtgcacagtcactttggaaaatagtctcacaagttaaagtgttattatttgatcaagacattccagtcctagtcatatactcaagaaaaatgaaaacatatgtccacataaaaacttgcacaataatgtttctaagagcattattcataatagccaaaaggtgaaaacaacccaaacacccaaaaagataaataaacaaaatgtgccacatctatctacacaatggaataatatgaagccatatgaaggaatgaagttctgatacatgctacaatgtggctggaccccaaaaacatcatgcttagtgaaagaagccaatcacagaagaccacatattatgtgattctgtttatatgaagtgtctagaataagcaaatagagagagatagattagtagctgcctaaggctggaggaggacaagaggttgggggggctgatagctaaagggtttctttttaaggtgatgaaaatattctgtaatcgactggttgatgactgcagaattctgtgaatacgtgaaaaaccaatgaattggttttttttttcatttgtttggtttttttagagacagggtcttgctctgttgcccagtctggactgtggtggtgcaatcataacttactgtaaccttgaactcctagcctcaagcgatcctcccaccttggcttcccaaagtgctgggattgcaggcatgagccaccacgcccagcccaaagactactgaattgtatactttaaatgcgtgaattgtacagtatgtgattctatctcagtaaagctgttaccaaagataacaataattagaagctttccattaatctctacagtctagaattctaaaaaatacagtatttagactgtattcaaattatctctgtaaaccaatgacttctggtgccttctaaatatctttcatcatccttccaaacctctctacggttaccagctgctatggcttgttcttttttttttttttaacttcttttaggatcaagtttgagtttatattttgctatcacctctcccgtattttccaacttttttttttttgagacagagtctcgctctgtcgcccaggctgaagtgcagtggcacgatcttggcttactgcaagctctgcctcctgggttcacgccattctcccacctcagcctcctgagtagctgggactacatgcacctgccaccacgcctggctaattttgtttttgtatttttagtagagacgggtttcaccatgttagccaggatggtctcaatctcctgacctcgtgatccgcccaccttgtcctcccaaagtgccgtgcccattgttttggtttttttgttttgttttgttttgtttttgagatgagtctcgcagattgctctgcgagtggcgcaatctcggctcactgccacctctgcctcctgggttcaagcgattcttctgccttggcctcccgagtagctgggattacagtgcccgccatcacgcccagctaatttttgtatttttagtacagacagcgtttcaccacgttggccaggaaggtctccatctcttgacctcgtcatctgcccaccttagcctcccaaagtgctgggattacacgcgtgagccaccacgcccagccagattttccaactttcattaatgacatatagtttccaccctctgcagtcttctaacccctactagttcctagcataagaatctgtttttaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaagaatctgtttttggcaagttccctaaagcttctctgttgccaaagccaactgacattttccttttcttcccagaactcttggtggcatttcccaatcctgagtctctgcaaccagagagacccctgaccctgtccaccgttcagaatcatcacaccgaaaaagaccagagaggaattgtgatgagcatggaagaagatggagaaatgctgcttcccatgctcaccttggatgcgaacatctgttcataaaccccaccaccctcctccagggtgaagacagccaagcccctctttggcccagacctggtcctgggcctctttgctctctgcccatacacagccccttcacccccacctgcaacacagcatgtcatccattcaatcaaaaaaacacctactctggcttccatgctaggcactggagcaacactggaaaatgagacagaatttgctcattctcttgccttatgttctccatgccgcacaacacacttccctactgctccctgctccctgacaatcttggcagcaccgctgtcctcccagttccccaagtcagaaaccagagtcaccccaggcttctgatcactcccacatgccagcccccggctcccttccttcaactgctcttctccccttcactcccaaggtggggtctcctcttgtctggagactgcaggagctcctccttggcccccaccaccccacccaggtgcaggcctgaagtctctagttcaacaccaactctaacctgttaatcccacacttgaaacttaactgcctacaggaacaagcccaggcctctcagtgcagctctcctgagcctcaagcccaaccccctcctccagcaacacttgcactgtatcatctccatttggtttctgaacctaatctggcgctggcccctatgaacatggaggtccccatatcccacagaatatatcaccttctcccaggcagagtccccatctctcacccctctctctgtagctgtgctgcctgcactgagctggaaatgtccatatccacctcctcctgcctccactgcagtccctcacgggctggcagaggttccaactgcacaacctccccagaggcctcactcaatctacccacaggacagagggagagcactgtggccactcaccctgcggttccggttgtgatccatggtcttcagatgcttctggatgatcccaaactgcatgggaatgaagaggtcgcaggctgcacaatgggctgcctccaccttcttcacaaaatgctccatggcaatttctgtagtggggaggagggagtcaccactgggcccaggtgcctaagatagacccaggtgttcgagaaaaaaaccacaccagctcctcctcaactcgccctgccacttccacctgggcctgagccaaggctggtctcctgaccttccctgggggaacagaagggtgtcctgaccctgcaccgaaaatcaggagtgcaggctgaggccttgcctggtgggagtgggctgaaaatctcctcaccctgggtcagatcctggtctctgtagatttggtggatgaggccatcaaggtcctccacggtttttcggagctcctctgtcttcttggtcttgttagtgacgtactcctgcaaggaatataaaggttcatgtgggccgccttatgttctcaggggtccaagaaactaagagcggctgtgttactccaaggctcacctgcagaaagtcagccgtctgcttagggagcttggtgcctacgtacttaaagtgttccttgtggaacttgctgtcaagatggctggccatctcgtcctcatagaaggtccggtatttgcacagagaacacacaaactggatcctgccacaggaaggaaacgaggggctgaggctgcaagtgtcccaggggatagtgctgccgcctcacccaacccagacacaagccctgaaacaggccttgctcacgggcctctgaagtacggtcccagcagagggacaggctgggaccagtggggtcgggagtagaaagggccagaaagtctgcaggctgcagttactgcaacgtaggggacaggggaggagctcttccttcccacaggcaggaggctgaagcctgagacagcagctgctgcaacaggcaacgagtcgctggaaagttgctggagggcctcgctaccaaggctgggcaggagcgtgtgcacttggcccaggtggggaccggaaggaaggatgccctggcgtgagccaggtggccctgaggtgcagagtggagtacgcagtcccgaggcagggcccgaaaaggtgctgcatcttccttctgggatctgggggactcaaaggcccagcccatcctctgctcagaatgcttgggggtggtgtcgggagggatgggaggcagcaggcctgggcacctgctgcctcatcttcctcttccaagaagagaccagtctgagctggaaggagggcgcccgctcggcctgccagagggcagcctggagtcacctgggcgaggtgctctgtctgggcctggtgtccacagtagaagcccggggtctggggcctgggccggagcaggccgccgtggcaaggggcggaggaggccagccgccaccgagacctcggggcgggtccctacctctgccggacgtccttatctgggccacggggtcagctttgtctggagagcccaggggccgggcgccggcgaggctgaggaaggtccagcaagagcaagagtctgaggcggaggaggcaagcgccagtgcgggagccctgagggcagacagacccgaccaaggggcgtgaagggctcagccgcagacaggcccggcctgacagggccggcgggcagggcagaaggcaggcccgaggctgccacagcccacaggtgctgccatctctcctgggcacggcggtggcctcttggcagctagctggggcggcacaggcgccttggaccttgagtctctgatgagctggccccctccctcaggggcatcaggcccccagtgcaccttggggttcgtgcgccgagtgacctagcgccagagcttctgagcaacggtgccgagcggtgtcaggtctcggcccacagacgccagcggtcgccaggcggccgcagaggggcaggggatgagtcaggccttgggagctgggcctggcgggaagcagggtccatgcacggccgagcaggtggcggctcccaagggaggccagagggcggcgagctggcagagctatggccctgctctcctggcggcagccccacagcgaggcagaggcagaggggtggagggaagctggttacctttccaccatgcggtctcgctgccgctttttctgcttgtcctgactcttcttgcctgcctgcaacttgcgcttggtctggccattttcatcctgggtggttagggcccctgtgggagcagatgggcactgtcaccaatttggctctgccaggacagggcaggccctgcggcctctggctgaatcacccactgtccactccagagggtccatcgagaatagctgtccaagcaaggcctctggccatgagcagggctgggtatcctgggctgtgcagggagtgggtttggcctaggccccaaggagtgggggccaggcgatgacccctccactctccaggacacccatgctctctgtgcagtgggccaggaggaggctggaaagcaaagagggggtatctttgtggggacactggcacatgttcagaggggccaggtggtgggatgcagggaggctgctcacatggccctgcccacccccaaccgggcaccgcggcaacagtgggctgacgctggatttgctgttaggtacctgctggcgctcatcactcaggtggggggacacggaatcccaacaggggctggagaggtgctaagggagaggatacgcacaccagagccgtaaaaactgcaccgagggtcccagatcggacaccagccactgaggacttggaactgcgcgttactgagggaccgagggcagggggcgtgcctggggttccccacacttttactagctgcccccatctgaaggcaaaaccagtgtgctaggcaggggtcaccaccatccacagcctccgcctgggaaggaggaggaagagtgggaagggggtggaggcggcgaaaagaaagccccctgccagcacacactcgggcccacaagggaggtccccaactggccgcatgtctgccgcaaccctgccctcagctgggtccctcccactgtgagcccctggaagagccgccctagcaccaggcaccccaggaaaactcacccttctctggatcctctttgccttcttctctcccatcctcttttccctcctcatcctctccgtcctaacaatttcaaattccaactttaaaacaggtgcctttttttttttttttaaaagaaaccaagtttattagagcaacggtatatagtaaaacagctgcttgctccatagacagagcagggctatcctataggcagggtggcccagagtagcccagttatttacaatggctttaaatgacaaggcccggctatgtgccagaaacctcacatcctcccactacctggtgcacaggggctcatcccattttccaacaaggaaactgtgcctccagctaggcagcctgtgctttctgccagaccacactgcctccccatgctggtcaccatgcacgcagagctgacacagcattgcctctggcccccagggagagcaccactctttaggccagctcgccctgcctgcagacagaaaatgcccagccagagccacttaccactctggagcccttctccacagcctcggtgccttcaaggccctctgtggcttccccctcggtgccctcatctgaaagggaaaaggaggtaagctcaacccaggagttcccagaggcagggggcagccgcccagtaccacctagtgggctcaccattgtctgagtcgctgttgtccgagcagtccgtgcgggtggctttgctatctggctcatcaggactgccgccctgctttctcttcttcttcttggtctgggtcataagggggggaagccgtgtcagggtgcatggcacccggcccttagctccgccccagtgggaactaagcttcccagaggggaaggctgcctccactcactcggaagtcggctgtggtccaggtcttccaggtccgcctcatctgcttcatgccattgccaaacccgaaaccaaagcgggagccgcccgggaaggcgcccccacctcgcatgccctggaacatgccgtactcggggatgatgttctgggagaagagggagggcagccgagaggcaccagacatgcactggccccgggcccccatggggtcttcccacatgcgcccatagcctgaggccattggccggccgctccgggcatcccgggcccagccctgtgccctgggaccgaaggtgtcgttgccacgcatgcggaactggtcgcggtaggcatcgtattggccctcataggccatttccatctcagggtcaagctcgctgtagtcatagcctgaccggtacaggtcgcgctcactcaggacggccctcgagtcgcaggactcataagagtcatacctgcagaggcatggggtgagcatcaggtggagcccctcaggatccctcacctccaggcaactgctcctgccctccccaatctcccagtccagcacccaccctgccctggttgggaggctcaatgttcagaaatgccgattaaagagttccagcctctcagctgatataggggcaccactgccccaaacttgaatgtagccacacactggcttggggaccctaagaaggactgaaggactgataactggggtggaggctctagtccagtgagtctcaacaaggggcagagctgctccacagccctttgggaacatgtacaccatctgtgggagctgcaacgcccaaggctgctcctcacagggcaaggctgagcaccccagcaccctgcaggatgcaggcaggtccagcacaatgaatgcgcagccagtgaggctgatgatacccatgggaaacactgttcttgtccctcatggctggggaaccttcaaactctgcaaagtccctcattaccaaaacgactgagacaaaagggggagtatttcccagggaagacactgagagcttgcccagggacaagaaaaagagctgtattacatcaaccctggagcccagagccagacaccaaactctatataccctgtattgcaactgggaaggcaggccagacctcctcccaggacacagagggcaccgcagagagctcttttaaccgtgactgcagcccgcagcccacacccctacaggcctggaccccacacacctcacaggcacaggggctccccttgcacactcttccctaaacctgggccaccaagaggcaccggcagctctaagagcagcagttggtgctgccgctgctctgcttaccccgatcccaggctccaggctgtggtaagaaggtgcatagcagcaacgcaaggccaagcctcacatgccaagccctcagctctgagtgctgcagctgttgggccaggagttacagagcccatggcatcaaatccccttgtgcctgttccacaccctgccaccacagccctggggcctcccttggccctatcagtgctcagccaggcaactccttactcttggctctcactcatctgttagctggtgctccactctatcccatgttagagatacacccacgctcctcaccaaagcctcgcactgggcataagcactcctgggccaagtccagttcagttaataacaaatgcccacagcatgatgctttggagtagggcagatctggtaggcgaggcccagccccaccaagtacttgctgcgtgccttcagggtatgacctgcctgcacttctgtatccccacctgcaaaatgaggacagcagcagttcctcacaggagtgcttccatcaggtacatgtttgtaaggcacaggagagtaaccaggaaatgcccacacctgccccgacccttacgtgggggtggcccagctcgcagtgatcagccccaaacgctcgtcccacccttcacaccaaactccatctgtcctgccctgacaccacgcaggaggcaaagtctcgagagaattccaaatggctgtccttggagggaggggtggctgaacactctgtttttgagggcacagtgaagtctgcccagtctgggcttgttcctctcaccgcaagctgggaaaggctgaccaccaggcagtgcggcaggggttgagggtgggtgagaggagacacaagtcagagacgggaagtgcaacggaccctgctgggagccacagcagcaccaagcagcggggaggaagcagacacagaggggcactcagagaggaaaacgcagtgggcagcaggcaggagccgcccctgcagagtctcaacccctaggcaggtgtccactcacctttctccacctgagccgtacacgcctccttgcatcatgtctgtctccaaatgcggcaccatatctaagcgctggttaattctggataaaacggaatcggcactggcgctacccgaggcactagtgtttgcatttgtgtcagagctaggcatttcccaagagtgtgaagtggccataccatacccatagttggtggtgttatcctggccatagccatagccatagccatagccctcgtagcctgcagtgagggagacagagacagacagatggtgggggcaggcagaggggaggcagacagagacagagacaaacacagatacaagggtatcttctgtcacagagagagaagaccctagccactgaagctagatgggccctggtcattctgatgagggcctcctgttaaggagtaggtaaccccagaaacatgccccctccccactcccaaccttggccaagcagggcagtggcagagaaacacagccaggacaaccccaagggacaggacagcaatcacaggaatgacacttgcctctatttgtcccagagttccaagttccatatcctacaaaaagtaaaagggcagttacatctatacttgcttacaatacaaggccataattcaggcgcagacaattattcccaggacctgactggtcagagcaggctgcacctcccctaaccgagaagccttgagctcgcgagcactgcgcaaatgacccaggccacttgctgccctggtgcctggctgcctgtggctctgagcatctgttatttaaggatccttctgttcccaacactctcaactaaggaacttggctcctatactcctccctttaagagccagaattagaaggtgacctccacaccccaagctaagtgctaatcagtttatagcagaaaacccaaccccagtctcccaagagtctgccttaaaagggagggccaacaagcccttgaattgttgactgtgctgtgctggaacacatcagtgagagaagcccaagaagcaacccctcgcttgagaaaagctgtggagagaacaatctggattatcaacttaatatgctctggattcaatcacaacacatgataaaacctcattccttcagtaacataaagccactgagaagtgacaaagtgtaaagtcccctgggaactctgagtcaaacacacagttcctccccaaaggagggcacagagcaggtgacccctttccctgggtctctggtgagacccaacagttgtttcccattccatgtcatctctgccccgcagaggacatgctcatcccagggcaggggaccgaagctcagtgagacagacagcagggcaataagtggcagaagccagaccacagcaggaagagtgtaagtcaactgaaaagatgagccagagagaacaggcaggctgtcgtcctgcacttgggttcctccacgacccagtgcacaaaaagaatgggaagaaatcagagagaagctgaggaactgctgatgaccactatgtttaacaagagagctcacaaaacaaaaactcttgggctggagaaaccaaaacaggcttctcatccatttgtttatgtatcccctgagcacagggaacagaggcttgcagtcccaggcactgctcaggcatggagatctgcctgttggtaagagagatgctaacagccagagagcagcatgggtaagtcaggagtggtagctgaggaaagaatggagccattctaagaggcaagagaggctggcagagccacataaagaaaaacacacaaggctgggtgcagtggctcacgcctgtaatcccagcacttcgggaggtcgaggcgggcggatcacctgaggtcaggagtttgaaaccagcctggccaacatggtgaaaccccttctctaccaaaaatacaaaattagccaggcgtggtggtgcacacctgtagtcccagctactcaggaggctgaggcacagttgcttgaacccaggcggcagagtttgcagtgaggtgagatcgcgccactgcactccagcctgggcgacacggtgaaactccatttcaaaaaaaaaaaaatagaacaacacacaggtagcccaggcagctactgtacacctggccaagtgactgtttgtaccagggacagtgggcactagctattctaaagaaaataggagttgggcgtggtggctcatgcctgtaatcccagaactttgggaggccaaggtgggtggattacgaggtcaggagttcgagaccagcctggccaatatggtgaaacctcatctctactaaaaatacaaaaattagccaggtgtggtggtgcgcgtctatggtctcagatgcttgggaggctgaggcaggagaatcacttgaacctgggaggtggaggttgcagcgagccaagattgcaccactgcactacaggctaggcgaccgagcgagactctgtctcaaaaaaaaaaagaaagaaaagaaaaagaaaataggatatggaggcaaaagcagatccatcagggctctgcttgggaggctacaatgtggtcactgcaagcttcacctgctgaggatctgccacaacagagtgaggaggcacaacgaaaggaagcagcatcaactccgtgaacaccactttacgttttaaggacaagcagggcctcccacgatgggcaactctcaggagtccctccaggcaaacactcactacatgccacttgctatgcctggagcaacccagactccttgatggacatcccagctgggtcccttcaggaggaagccttcatctagactggcgtttagggactccccaagacctgccctttctgaaagaacaccccaactcatttccatccccagaagggatgagatcatggttgacaaaagaaattttaaggagagagagagagagagagagagagagagagagagagagagatccttaaaatttatatatttattattattaaatatatacatatatatgtaaaaataagatatatgtacatatatatttttgagatagagtcttgctctgtcctccaggctggagtgtaatggtgtgatcacagctcactgcatcctcgacttcttgggttcaagtgactcttctgcctcagcctccggagtggctgggacaacaggcatgtgccaccatgcccagctaattttttctatttttgtagagatagggttttactatgttgcccaggctggtctcaaactcctgggggctcaagcctcccatctcagcctctcagagtgctgagattataggcatgagccactgcacctggccccaaggacataatttttaaaagaaaaaaggacatggtcacagtatgtgatatttatggaccaaaaatagaaaacaatttaacactcaactttaacgtaatagttaatcagattacacctacctactcggtgacatatcatgtaagcatataaaaagaatttactatgccttatgtggcacaaggaaatgcttctaacataaaataaagcaggaccagccaggcgcagtggctcacacctgtaatccttttgggaagtggggcaggcagatcgcttgagcccaggagtttgagaccagcctgggcaacatagcaaaaccccatctctagaaaaaatacaaaaaatagctgggcatggtagggcatgcctgtagtcccaattatgcaggaggctgaggtgggagggctatctgtgcccaggaggtggaggttgcagtgagctgaaattgtgccactgtgctccagcctgggggacagagtgagatcatatcttaaaaaaataaaataaaataagagcagtacccacaattctatccacctataaattattaaactacacaaaatcagtaagctgataaaaattaaacattaatatggtaggatcttggttgactgtttttcaaaatgttatttaaatgttatattgttcttgcaattcaagccagaaggaaaaataaatccatctctattctttcacaattgtgtatgtaaaaaaatctcaaacaaatctacaaaagagctactagaataagtgagcttagcaaggtttattacaaggtcaatctgtaagtcaaatttcaaatattacaaggtaaacctacaaatcaaatagcaatcaaatttctatatatcagcaatgaatggaaagtttttaaaagtaccatttcctatagcactaaaagcatgaaaaacttggcgtaaatctaacaaagtatgtgtaggatctgtgttgaaaactacaaaacactacatcagtgaagtgacatactgcactcatgaatcagaagacttgatattgttaagatgtcaattttctcaaactaatctatagattctacagatttgatagatctatagatccaaggctctctcactcaaaatctcagcatgaattttttaaaaaacttcataaactgattctaaaatttatatgcaaaagcaaagaaactaacaattttggaaaaaagaacaaacctggaggactcatatttcaagattactattaaccagtaatcaagactgcattgctgggcgaggcgcagtggctaatgcctgtaattccaacactttgggaggccgaggcaggtggatcatgtgaggtcgggagtttgagaccagcctggccaacatggtgaaaccagtctctactaaaaatacaaaaagaccgtgctgctgaacgaaatttagatgtacagaccaatggaacagaatgagagtccaagagtccagaaatagacccacagtatatggtcaactgattttcagtaaaggtacgaaggcaattcaatagagaaaatataggcctggcacagtggctcacacctgtaatcctagcactttgggaggccaaggcgggtggatcacctgagatggggaattcaagaccagcctggccaatgtggtgaaaccgtctctactaataatacaaaaattagccaggcgtggtggcacatgcctgtaataccagctatttgggaggccaaggcacaagaatagcttgaatctgggaggtggaggttgtggtgagctgagatcgcgccattgcactccagcctgggcaacaagagcgaaactccatctcaaaaaaaaaaaaaaaagaaagaaagaaagaaagaaagaggccgggcgcggtggctcacgcctgtaatcccaacactttgggaggccgaggcgggaggatcacgaggtcaggagctcgagaacatcctggcaaatacggtgaaaccccgtctctactgaaaatacaaaaagattagccaggcgtggtggcgggcaactgctcgggaggctgaagcgggagaatggcatgaacccaggaggcggagcttgcagtgagctgagatcgcgccactgcactccagcctgggggacagagtgagactctgtctcaaaaaaaaaaaaaaagaaagaaaaaatggttttgtttttgtttttgttttttaaacaaatggtgctggaacaattatatatttatatgccatagaagaataagaaaccttaacctatactgcacaccttgtagaaaaattaactcaatatggatcacagactaaatgtaaaacccacaactaaaacacctaaaagaaaattctaaagaaaatattacagatttcttagatataaaagcaaaaccatcatctattaaagaaaagattgaattgggcttcaaaattaacaacttgtgttctttctgacacaagacaagacacactgacaagagaatagacaagccacagtctgggagaaaatatttgtaaatggcatatccgagaaatggcttgtactcagaatatgcaatccagagggaaaataattcaaaaggatgtgcaattagggactacatttgatgaaaagggagaggcagggagggcagcacagggaagtcaagcaaaccaagtttctcctcatttatgagacacctgataccttctcactcaatttcaaaatattttaagtcttcccttttcctgggactagctgctgttacttggggagcttacttaagtctctttatgcagtgacccctgaaggcatgttagctgtgtaggatcagtctttccccagatcttggtagtaaaagaaattacccatctcagtaactaagacattatccctgttaattccaaagagggctccttctcaacagatacccctagagtcacagacaaccaaaaaccagctttaacagcagtccgggctgccacagcacacaaacaaaacagcatctgtgaatcctactggtggctacttctgaattagctaattaggtgtttctgtccacgctggaaaactcaatcagagatcttcactcaactctgtgtgtgtggagcctgctggcttgaggtggcctggctgagtctccaaaagctgccagattcacacactcagcctctctcccacagcaaggacatgcactatgctgggactaagttaatagcttgctttctcctggaccaatcctttggacttttttttttttgagacagagtcttgctctgttgccaggctggagtgcagtggcatgatatcggctcactgtaacctctgcctcccgggttcaagtgattcccctgcctcagcctcctgagtagctgcgaccacaggcacacaccaccatgcccggctaattttttgtattttagtatagatggcatttcaccatgttggccaggatggtctcgatctcctgacctcaagtgatccacccgcctcggcctcccaaagtgctgggattacaggcaggagccaccgcgcctggcctcctttggactttaattggccactgtgactcccagtccctcccccatggggatttgaagccaggccttttatcaaagagcctaacttgctcaggaacacagctacttttcccataattgcctgaaagggaagcactagctattcaaatggccacaccatttcacacaagtttaggtttaaaaaagcatgacagggtgacagcaaagccaaaggcaactaagaagacaaggaactgctctgcagaacactttggttcccaccagaagtccacacttaccataatcacaggtgggctgagcgctggtatccgagtatgtcgactgcaaagtggtttcagatccctggacaaagcctaaacataaagacagtggggttaatttccacaagcaagtcacagggaaatgacctgagactacctaacctttggtataggattgccagcaggcccttctctcaacgaaaagccaccaaaacctctagattccacagtttaattagaccgtcagaaaatattacccaatggaaaggcaggctatgtttaacttgctataccaggaggactagattaaaaaattatttatttactttttaaaaacaaggtctcactctgtccgggctgcaacgcagtggcatgatcacggctcactgcaacctcgaccttccaggctcaaacaatcctcctgcctcagcctcccaagtagctgagactatacgttcgtgccatcattcgcagctaatttttatacttttttgtagagatggggtttcatcatgttgccctggctggtctttaattcctaggcttaagcaatccaccctcctgaacctcccaaagtgctgggattacaggtgtgagccacagagcctggccccaaataaaaatttttaaacatttaagccagtagcctattttgagaaatgaacacccaagttatcattctgttaaatgaggaaactattcaaatccctgaagggtgagccacttggaattcaaacaaggatggaggttagcttcaaaaccatgttaaagcaaataatacccccctccctgttctaaatctgaaacagaaactgctttttattttggttttcccattaaaaagtgtgtataacaattataacaattatttctgggccgggcagtggctcatgcctgtaatcccaacactttgggaggccaagatgaccagcctgggcaacagggtgaaaccctgtctctacaaaaaaaaaaaaaagccagctgtggcagcatgtgcctgtagtcctagctacttgggaggctgaggtgggagtgtcacttgagcccagaaggtcaaggctgcagtgagctatgattgcgccactgcattccagcctgggtgacagagcaagaccctgtctcaaaacaaaaacaaaaacaaaaaacaattatttcttaaaagtaattatttggggtggcatggtcatatggaaataagtattattatatatacataaaatttcctatcttctcaactttcaaactatttctcaacataaaatgaattagggctggatgcagtggctcatgcctgtactcacagtactttgggaggccaagggggggtggactggttgaggccaggagttcaagaccagcctggccaacatggtgaaaccccatctctactaaaaatacaaaaattagctactaaaaatacaaaaattacagggcacagtggctcacgcctgtaatcccagcactttgggcggccgaggcaggtggatcacgaggttaggagttcgagatcagcctggccaatatggtgaaaccctgtctctactaaaaatacaaaaattagctgggcgtggtggtgtgtgcctgtagtcccagctgcgcaggaggctgaggcaggagaatcgcttgaacccaggaggcagaggttgcagtgagccaaaatcatgccactgcattccagcctaggcgacagagcaagactccgtctcaaaacaaacaaacaaaaccccaaaattagctgggtgtggtggcacctgcctgtaatcccaggttcttgggagggtgaggcagaagaactgcttaaacccaggaggcggagattgcagtgagtggagatcgtgccactgcactcaagcctgggtaatagagcaagactccatctcaaaataaataaataaatgaaataaaataaaatgagttagtgccaagtaaggaaaacttctacctctatcagaaaccagtgctcctacagactatgactgatgctaatcctgacacttgctttaaaactacattaaaaaaagaaaaaacaacaactctacagttagaaatacatatatatttttttgagacggagtctcgcactaggttggagtgcagtggcacgatctcggctcactgcaacctccacctcccgggttcaagcgattctcctgcctcagccttctgagtagctgggactacaggcgcgtgccaccatgtccggctgatttttttgtatttttagtagagatggggtttcaccatgttagccaggatggtctcgatctcctaaccttgtgatccgcccgccttggcctcccaaagtgctgggattacaggcgtgagccactgcgcccggccagaaatacatatttttgaataattttctctcagcactgaaattacgacagataccataagaggcagtatttgcctttcccatcagagccaactcatgacctgaaaattaaagcctatgcctttaacagcttgtttacatcaaaaacctacagaagtgccttccccctgggtaagcgttctcttatttgttgacagtgtctctattttatctcttaagaccacagcagcagcagccaacagcaaacaagtgctttccctgcagggtgctaagaacatttatctgcaatgatctcatttcatcctcaccacagacaataagggcaggtgggcaagattccttactctgcaattcccccaggtccaaaagggtctgaacaccaagtgttttctaccagtgtggtgccaaaactcacgctggagctgttttcacctgtaaggacatttataatctttctttgtcctacttagtgcagaattaatctatttaaatacaaggtgcttccccagaccccacgtgacttctcttaagctagaattccaaaatacatctagctccaagggttccaaagacggagctgtgaacccagcttcatcttcactttccagagtagggactgggacttgaggcaggataaaaccgagggtatacagatccagtcttctaccttccctaagtaaagaggctagaaatccattcaaatggattccttccagggatctggaccttcctgagatgcctaaaatccaggcattgttgattaatagctgtccataagaaacactgagagcagctttgaagagttcacccaggggaaagccttataatgtaaggaatacccagcccctgcggtctccactgtttgctcaactggcctctggaaacttgttctttcagcaattgggccaccagtaaaatggcctcagactttaggtaatgtgatctgtgagtactgcaactgcaaatgacagcctaccacaccctcacaagatacagtcagcaagctgctgagcaaaatatctgtgtctgttcaggcgagaggggccctggtgcttccctaggaaggaaagacgatccatcaaaccctccaagatcaatggcaatctctgctctaactctataccctgcaccacattaacattctgttccacaataccatctgcaaagatcgcagagcaggcccttctgtagccagttttggctcctattatgaataattcttttttttttttttttttttttgagacggagtttcactcttgttgcccaggctggagtgcaatggtgcgatctcggttcaccgcaacctccacttcccaggctcaagcgattctcctgcctcagcctcccgagtagctgggattacaggcatgcgccactacgcattttgtatttttagtagagacgggttttctccatgttggtcaggctggtatcaaactcccgacctcagaagatctgcccgcctcggtctcccaaagtgctgggattacaggcgtgagccaccacgcccggcctaaattcttagctggtttgtaaagtgttctcttggtacaatttatcagcctgattagcgctggttgaaaaaaataaaatatgccctatatggccctataaagctaaatgttagatcacagatttctttttttttttgtttgtttgtttttgagacggagtctcgctctgtcgcccaggctggagtgcagtggcacgatcttggctcactgcaagctccgcctcctggggtcacgccattctcctgcctcagcctcctgagtagctgggactacaggcacctgccaccacgcctggctaattttttgtatttttcacagagatggggtttcgctgtgttagcgaggatggtctcgatctcctgacctcgtgatccgcccacctcggcctcccaaagtgctgggattacaggcgtgagccaccacgcctagcccacggatttctttctttctatttttattagagacagggggtctcactgtcatccaggctggagtgcagtggcacaatcactgctcactgtggcctcagcctccggggctcaagtgatcctcctacttcagtctcctgtatagctgggactatagccacgcaccaccaggcccagctaatttttgttttctttttctttttttgttttgagagacagggtctcactatgttacccatgctggtgttgaattcctgggcttaagcaatcctctcactttgagaccatggatttctagttctgcagcaacactccttgcttttaaccaatctctcgtcaactttttttgctcaaaaatacaaaagcaggccaaatgctgtggctcatgtctgtaataccagtactttgggaggctgagttgggaggatcacttgagcccaggagttcaagacctgcgtggcaacatagtgagacctcatctcagaaataaaaaattagccaggcatggtggcatgcacatgtagtcacagctacttgggaggctgaggtgaggtgggaggattacttgagcacaggagggcgaggctgcagtgagctatgattttgtgccactgcactccaacctgggcaacatagtgagaccctgtctcaacaaaacaaaacaaatgcttctcagttttatacttttcctttctcctttttaaaaaagagtatatattttcttgagacaggatcttgctctgttgcccaggctggagtgcaatggcatgatcatagctcagcaatgttgaactcctgggctccagcaaacctcccagtcagccgggcgcagtggctcatgcccgtaatcccagcaccttgggaggccagggagggcggatcacaaggtcaggagatcaagaccatcctggctaacaaggtgaaaccccgtctctactaaaaatacaaaaaattagccgggtgtggtggcgggcacctgtagtcccagctacttgggaggcggaggcaggagaatggcatgaacctgggaggcggagcttgcagtgggccgagatggcgccactgcactccagcctgggtgacagagcaagactccgtctcaaaaaaaaaaacaaaaaaaaaatcccagagtctcgctgtcatccaggctggagcacagtggcacaatcatggctcactgcagcctcaacctcgcagagctaacttttttatttttaatttttatagagaaagggtcttgctatgttgcccaggctcatctcaaactcctggcctcaagcaatcttcctgcctcggcctcccaaagtgttgtgattacaagtgtgagccaccgtgcctgatctaaaaaaaaaaaagagtcttatttgaaggagtaacacagagtaccaaaaattaaaagataactggaattaggttaggttgccttcaatctttattatctgagccaagagtagggtgacaaccatcctcaaagatggtctccattcctgcctcttaacgttatgtagatccctcccaactaatagagctagccagtgcaaccaataagatttatgaaaatgactgagtgtgacttctgggattttcgccttgctctttctgggatcattcagtctggagaaaaccagccaccatgttgtgaggatactccagcagccagccctagggagagatccatggggccaagaattattggccagcatcagcctgccaggcatgggagtttaagtcaccttggaggtgggacctccagcctcagtcaggctttcagatgactctagtccacatagagatcctaaatgtaacctcatgatattccaagctagaaccacccagtgaaatcacctatccattccaaacataaagaaactgtgtgagacaataaatgtttctatgacaagtacagtagcatttcagacctttgtttgagggcctgattctggatatttctgtgctgtttaccactgctctcctcttcccctctcagtgctagagatgcagcttcctttcccacgtataaataaggtaacagggttcaaaagcagggcgagttaataaaaagatttatcagtcaccttttatgtttaataatgctaacatttgcttcgaggcctctaggacttacccttaaagctattagttgtctgaaatgtgaattaaaatgcctttgactttagtgccctacttcttaaataaggggaagactcacattgtaaattactgtggttttcagtttatcaagataaaggaaaaactaatcattacttttttagcttggctatctcagtgcccacccaaacccagaactacagcctacaagacctagagctggaattcaggtttggtcattagtgaccttgtatctcagtttcctcatctattaaaaaaaagagctccattactcagctaccccacagcacccaaccattcatcttctggtttcttcaagagtcctgtttttaaaaaccatgaaactgtcttccagttcttggtaagacttggtgagaattatattccaatcccagggatgtcagtaacaaccccatagtctttcctcctgaactaggaaagctacagaaaggctctggcagagctgcccaacttgggcactactgatgtttgacgccagatacttctttgcggtaggtgtcattgtgtataccgtagcagggcagcatcccaaacctccatccactagataccagcagcactcccactcccatatgtgacaaccaaaaatgtctccagacattgccagatgtcatctggggcagaatcacccctggatgagaacccactgggctgggggatggttgctagaaaaactggggttcttggaaagctcctgacctggcagccagggtagaggggactggcactaccttcttgcctatgccaacataaagtggtctacaaaggagccccacagactcacgttgcattctcagttctcaaaattccaagtagaatgcaggttacctggcaaccacacacgctcaagcctataataccctcaccaaacagggaggcctagtgtaagtctcctggccgagaagcctcatcagtcactgccaaggcaaacccaggaggccttggcaattcacccagtgatgatttacagtcgcccaagcatattgcggggggcggagaggggctctcggatctgtcacccactctccctttcaaatcccattggcctcccactggcctccctggctgatcttctaacaagccaggcagttcctgcccgtaagccttttacagcaaaagctccctgggccagatatctttattcgctccctccatttaggtctctgctcaaatgtcacctctttacagaaggctccaaccactccacgtagtggagcgacccccgcacggtactgaccaccctaaaatatatcctacactcgcttatttgcctattaagatcctcgcctctaagctgcttgaggaattcttgtctgtattcccaatacccagtctgtaccggacacggttcatttgacagacgcagagggaattaacatggaaccttgtcattccttgcagttcagcccctaggggcccaaggctccccgctcagcccaaacccttccaatatttacttatccccctagggcctggcgcctttcccagttctgaaatagacaaaagggggtggtgggtgggatcgggatgggggtgtagagctgcggcgtttttgcagagaaactgcgcgggggaggacgcgacaatggcgacggcagccgagcctgctgcctgctcgcaaggaccaaggcctgagaaagggaaacctaaggcgtcgaggtccaggagcgcaggccagggacggaggtggtgggggcggagacctcgtgcgctgaggcccggacccacggacacaggcgacagaagccaagacatcaggcggccgggagccgggacgccggctgcagacacagagagctgaggcaacgaggcgtgagggcagcgaccctgaggcgacgggccagcggcgccattttgtgaccgcagggaaggcagtgacggggccccaggggaggtgcgggcaagcctggtgcggcatccgcacgtccctgtcccatcccccacgcagagcccgaccccaccctgccaggcccacctgtgtagctcatggtggcgggcaacacaacatccgacgacgccggcttctgctgctctgaacatccgacgctgcgatagctgctgctaaccacagggtcccctccacacacacccgagccccgcctcccgaccgcattggctcataccggcctcggcttcacgtctattggaaggaaccgctgtctatctctatgcctcctcatatcagtggctggaagctgctggcaatctcgtgagagccccgccttgtccccgccttctgttattctaaggcctcagtgattggcctacagaagccggcagagaggcggagtcctatagaatttgagggggcggagctgtgcactacggaaaggcccaaggcccaagcatggtcgggctggaggagcgcccgtaccctggagacccgccagagggagtcgggtctacggctcagggcagggctgggatgccaactccgccaccgaggtgctgggtaggggacctagctaagtctctcaaattctctggccttcggctccaaaacaagcatagcaaagccatgttgagaagagaaaattaaaacagcaccaaacaagatgctggacacacgtttcaacattacgtgacaaagtgtgtgtaaagaaatcattctggtgccagtgcactgaataaatgtgattaatcgtaacaaaacgataatatatttatatggcatatgcttatatgtgtaataattccgtttgtattgtgtgtcattcgaatgctccttcaaacctgcaaaaagcttttaatcctcacttaaaactgaagcttggaactcatgatttgctcaaggtccttgacagttacgtgttaaaatgggagctttgcttctaaaaccctcctgattcactctgggctcgagagatcctgcaatagtgcagccgggcaccagtcatgtcctcagtctgtttcctgggcatatggaaaccctgccagggacaactcataatttctagagatgacagagctgcaccgaagagtacttaacacgtgtgtttgtgaaaactcattaagctgcgcaattacgacttctacgcttcgtgtgttttaaaactttttttaaggtatgctgtttctttttgatattgttgatttctttaggtgtaatagtggcatttacaacgttgagagaaacatactgaaatactaagaagttaactgatcttatggccaggatgtgcttcacacaattcagacaggtagagagaggaggaggaagcaaggagctataagataaatctctgacagctgaagacattggtcatgggttggtgatggatagatgagagtccattttactgtttgctctacttttgtatagttggaattctccatgataaactgttttaataaaactccccccacccaaatgaggcttctgcagaacttgctgccatacggaacaaagccacttctgatgtgttaagtgagcaaactccaaacatgaagcagagatctgacggataagcactctggcttcggggttcatctccccatcagcctcagggatgcctgcctgtcttccaaaccaaggcagggccccaggacacgtcttctgcgccctgcaggttcgttccttcatcgcacttgccacagtcatcattgtaccgatttgatttcgttcacatccaacaccctcagagaccacggctcaaaagctgagactttgctgcctgaggtgtattgaagtggcttgagcagagaagagcaatgctcagaaagttttaggaaaacatccccctgcaagaactggaggtgactcttccaaggacacacatgaccctcacttcactgcatgattggtggggaggaacttgccatatgactttataagctcttgtatcatttgactgttttttgtcacatctagcctataccacttttatatttcaaaaactgacttacgggccgggcatagtggctcacgcctgtaatcccagcactttgggaggctgatcacttgagctcaggagttcaagaccagcccgggcaacatggtgaaacccccgtctctacaaaaattacagatataagccaggggtggtggtgcatgcctgtgatcccagctacctggatggctgaggcaggagaatcacttgaacccaggaggcagagactgcagcgagccgaggtccctacactgcactccagcttgggcaacaaaatgagaccctgtctcaaaaaataaaataaaaaaataaaaactgacttatgaaaagttgaaagaggaagaaacacctttgagtcagctcacaagatgctctccctgcttcctaagtcctggatacatccacccacccacagcacaggatggagagaagtggttgcggccttctgccaccaggcgagatgtgcgtcctgaccccacaggagcagacgtgtgggccaagaccacccttgtgggcgttattgcagcctgttaatccctccttcccaggaaggggtatggtgggagggcccagaaagcagggctgggggtagaggtggccccttctgtccacacgccatgaggtcgttcccactctccagcacttgaccgtttagtaaaaacgatgagctgaaaaaccacatgcaataaacaagaaggagcagccaacaaaatctcttaaaatctcagaaatgttcaataaacatttgcagagcgagaaaataaataacatcgcaaaggagccagtggctcctcttttccccgcatgttccttgggtcaggggtgcatgtgtctcactagaagtcacatgtattaaaagcaggtgagttccagctctctacaaccccactggcccccacccaaatgctcccaacgggtccctgacaccctcgctggtagctcctgcctttgataagctcctctagcctcaactgcttcttgatcctggctcccttcccagacaggctgcccagaaccctggttcatctgctcactggagccgctttgccagccagccagagaccccctcccagccatggcctaaagagccaacagctgggaacttgggctcatccccagctgcgtctggtcggcttggcggccaactggaaaacccagggcctccatggcgctctggacagaggaggccccgatcccagccccggctgccagccaatgccagcctgtccacttgacagaaaaacacacgctggccgcctgccccagggtgtttccagaagagaaatttaatctaatttacatacttctaggtacatcgataaccaaaatgtggccactgaaaaaagttaaaaggtcaatcagctcctggcttctagctggcccaggattgcaaaataaaaagatccacgttccttattctctacacaaaacgcgtttttaaaaaagtgaaaggtctagggagctatacatagaaagcaacagtgaaaagggagagggagcaggagtgggggaggagagtcccaccccccaaccccaccctccagggccccagagcccctgaggctctttggggggccttgacatggcaggaggcagctgtcagctctgagctcttcccagctgggaaggcccctctcgggggcagccaacaaggatttccgtggcattgtgggctcagtggggggctcccaggccccagcaggccccacagagggagcgtggcttcccctgagcaagcaccgtggcatgatgtggtcgttcaacccaggaactgggggtccggggcaggtcccgggtctcacgaggtgcgtgttgtgtgtgttcgcatgtacatgtgtgtgagaggatattcatgggggagagagggaaccagaacaggggtctttggggtctttgcaaatggccacggatggcagacatcgccctgcctggctgctagacgggggagtgctgtcctcccctgtgaccagaccggctgccatcagagacctggctgctgcccctgctggaccaggtgggcatgggctgaaggaagacaccctgtggccccagagtcctcgggctgggggaagggcagctagctggctcccggcgccctggctgtagtgtgcccggcccccaaggggcgccggtttgaggttttggcttgctcctttggaaacggaaagaaagaggaagagggacaaggacacagaggaggaagaagaggagacagaggtggcacgagaggggatctggaatgcttttgtgttagggagcctctgccgccgctgtctgtgcctgcggggcctgggactcctcaggtggggggtccgctttggagaagttcatctccaggatgtgccgctgtaagtgccgcacccactcttcctggatggagagggggccctggaattccacctcacagaacctgcatgggggaacagagagagggagtggccagtgctgtgaggagaggcggaagcatagccttgccagcatccctgggcacacctgctgctactcagtgtggacagagccagcccaggaggcgggggaagagggacccagaagtcaggcgtttcccatggacagccacctccactcaccatggggtcatggcagggtctcacagagacccctgcctctgtgctcagaagtcactggtgccaggtaagggctactggcttccaggtacccctgccatctggcagatacatagaatctgagacagtagagggcacagagaagcaaatcctacccaacgcaccaagccccccacctcctcctgtcttcctggcacctaaaaaggcctcacagcacagaggcctggagcccaagctccatggctcaagacgtggctttgactctgacttctgacttggcctgtatggcctcaggcaagtcacctcacgtctcagagtcccagttcgctgctcttcaatgtacttgtggactttggtaagaattaactaagatctacttttttcttgagccagacactagttgagtgcttacttaccatgtgccaggcagttctgagtgctttataaatattaaattcacttactcctcgtaacaaatctgtaaggtaggtttgttatcaacccgcttttatgagtgaggaaattgaggtaaggagcaggtaagtccttccctgaggtcactaagctggtaagtggcagagttgggatttgaacccaggtctcgcaggctacaaagctcagggtgtcagcctttagcctgagccccaccacacccaagggcagccactgaggcgacacctcccagcttccaccaaaccctatcctgttccaaggctccgggtgaccaaggtccactcaggtggtctccctccctcccccaggggcagcctacctgcatttgagggtgtagatgttgcccacgaacttgacaagtgatgtctgggggggccggggcaccagggaggggactggccggactcggggtgggggttgccgcacctcctccagcttctgctgtaggtcattggtgtcctcgcctccccgggctgcggaggcatctggagggcgggcttgtcggcgttcaaattctaaggtggagagggggacgggagatgagtgggaggggtggatgctgcagagacttggaatacacaagagctgaggactgatgctacctggatgggtgggatgggggatggatgggtgaatgggtaagcaactggagaaaggacttaagggccacagcagagcgcctggggagtggctgggtgggcctgacaggtgcccgctgcgctcccgaccctcctccaccaagcactcactgttgatgttctgccgctggtgctcctcagccttcacggtgcctggcgggctggctgccagaggccgctcaccaccgtcggctgcccggccagcctcgggccctggctcccctccggcactgcggccgaccacggccaggcccccgggtgccagccccagggacggccgcttgtcactgtcacggccatggccggcactgcggaacttcttggtgaaggggcggccgccctggatgtagctgcggtaggcgcccaccttctggggccggtgtttgatccactcgctcagtgtctcgatgggcgagccattgacgcaccactcggtcacgccgaactgccgcaggtgtgcccgtgcgtggctggccagggccttgcggttttcaaagtaaaggccacacagctcgcagcaggcctcggtggctgcggggcggagggggtgctgctgagtcacagcccaaagggggcaggtgcacccagatggccctgcccaggccaggtgccaatcccgcctcccacacagacccagccatgggggccccacttggggtcagtgtgcacgcttgtggcattgcctggcctggcaggccctggcggtcgccctcccaggaccctgccgcccgctgcttacaggagtgggaggtcttctcatgaagggtctttgccttgaagggcagttcagtctggatgtaggtcttggccttgacctctgctgggaggaggcggtcctcctgcaggggccgcttggctgccactgagcccaggtagccagtggctgagggcttggccccagtgatgggcgtcaggctgagctcacgaggaacctgggccggccctgcacctggtttgcctggccggccagccaggggcgacagcggcagtggggactgcacgggcccaggggccacggtgggaggcccgtcctcagccagggcaggggccaggtctccagccggtggctccttcttgatgaggcacggcttggacttcttcttgaggatctctcgcagtgtgtcgatgggcgaaccattgacggaccactcggtcacacccatctgccgcaggtgtgagcgcgcgtgactcgacaggcccttgcggttctcgaagaactcgccgcagaactcacagcggatgtcgcgcaccggctctgcccgggacgctgcaggggatccagggtagggggaaggaggaggaggaggaggaggagggaggaggagggaggaggagggaggaggaggagggaggagggaggaggaggaggaggaggaggaggaggaggaggaggaggaggaggaggaggaggagaaggaggcggcggctgcgggcaggaagcctccaagctcaaagcccccgtatcagtgccagctgcctagctacccctgtccacaccacccaccagaccgcaacaacctgctccctcatctgggcttccagaggcccttttaacatctggctcttctgcttgttctgtcacttcaaattctagctggcttcaagatacctccctgtatgatcctgggcaagtcactttccctctctgagcctgtttcctccgctgcaaaatggagatgaaaacccctacctcccagtgttactttgggacggtctaaaatgggaacagctctcagcatggggcacagagctggtacacaacacacgtgagcgctaaggcacaagcctgggctgccctcacctgctcagcacacagtgggcatccaatcaacctgagcagaatgaacacagtgctggtgtgacaggcaagcgagcaagtgacattacaatgatggcatacagagttttctgtaaccaggtgctgtgctaagtgctttatcccacttaatcctcaagaaaaccagacagagttgggactatgctgatctccatcttccaaatgaggaaacttgcccaaggtcacataaagctagactgtggaggaacagagatcttaactcacacttgactcccaatgtcaagcacttaattaccaaaaatgtcagaaagacacagttcagacgttcactgccagtccctacgctcctgctgtagcagacatcactaatggatccccgcagtctttctccctaggagtctggctggcagccactaccaatcgattgaaatggcacaagagatggaatctttctgctgtcactgaatgacacaatcctgcttctcaaatgaataaaggacaattgagcagcagctcagttgcaggggtctgcatagcaggaatacacagctaaccctgtgtcctctctacctgcgtgtcctcccttccaattcaaccctaggcactctggatacccccaaggggaggcagggaggagacccctccaactgttctccctgccctactgcagggtcacacttacacaggttcaggggtgtcatgtcttcccgtggtgccccccagggaccctcagatgggtgcagttccccatgaagggcccccggcagcatctcccgcttgatctccacccgtatttgttcaggcttcagcttcttgggcaaggagggtgcagccaggcctgggaacatctttcgggccgtaggaggaggagaggcagttggtgagtggcccagggggctgcccggtggtggtggcaacttcttggccaagggtgagatgtgaaggtccgaggggctgcgggcttccagtgagctgccaggacctgcgccgcccatcatcttggccagggcttttgggcttggccctggtgggttgggaggtccaccaggccgagactgggtccgtctcttcaggatctcccgcagcgtgtcgatgggcgagccattgacgtaccactcggtcacgcccatttgccgcagatgggagcgcgcgtggctcgagaggcccttgcggttctcgaagaactcaccacagaactcgcagcggatgtctcgtgctggctctgggcctgaggctgcagcaggaggagaaaggggcagttagcatcgtggaactgccagcatggtcacctgcaggagtgtcctggtcggctgggcgtgggcggcagcagcacgcccacaggttagggtggtgagggcaggtgcaggtaagggagtggaggagcggggctgggggccagatacccggcaggagtgaggggaggctccagagagcacatgggccctcagtcctggcggaggaggatggaaccaagattccattgctctgtgggtcccaacaaggacagggtgaggcagggaggcagcctaggtgctatgtgccatccagacaggggcagatgtgggtgctctgcacactaaaaggcaggatctccccaccttggccttcattctcaggaagggtcatggaggtcaaaggccaagagagagggcctagcagcccactgccaacaagatctctgggcagaaccggcccactgccaagggcccctgtctactccctgccccagcagggagggggctgtgaccccccccccgggaggggctccagggcccgcagtgaggagggggcagctgaagcgagaacctacagaggttgagaggagacggctccacatcagaggcccagaaaatgccggcggctgcggcggccgagaggtcctgcttcccccaggggctggccatacccgcggccttcagcttggccttcttggccggcggtggggggggaagcaaggagagggccgcggaggtgggaggcggccgccccgggtgggccagggcgccgcgcctgggtgggaggcggatctggacgccgtccctcctgatgagcccgtggagcacgtctatgggggatcccttggcgtccggatcgctgacgcccaggtggcgcaggtgggcacgggcgtggctagacaggcccttgcgggtctcaaaccaggcaccgcacagctggcagtccagctctctgcccccgtcactatctaaagctgcggagacaaaacacagggggggttcacggccgccaccttggccggccttgggggcctgaggtaggagggtctggtgtgatttttggctgctcaggcagttggggggtccaagactcaggccgcagatttcttttgaagtttgggaagcaggacatcctgtttcctgcctagccctttggcatcgaggggagtgtagagagcttaaggactttgggtagacaggcagtgaccaaattctaggtaatcagatactcccagaccctctcccctaggatccctgctatgggagctatttgggggcgatggtggctgctgggctcacgcagccaagggcacacctgctcaaggccctgcccctggaagcacggcagactcagtggaagcaacttcaagggaacataaggtgccaaatggggggctccattgggcagggggtgagaccctggggtcacccccagactctaatgtccacaaagatatgggaaagcctgatgttgtaagggacgtccttgttaaacctgctcactgcacctggagggtttcttcccaaaccctgcctgccgtgcccacaggcagcccaggaggtggggcttcaccggcaggcgcagagagctgcctctgcgtggtggacagccaggaagacttgatgacaggaccaatcgtgggcacctcccatcaggtgatcccctgtctatccaagatgcttccaactaccactgagaaagctaggccacaggaaccctggttaccttcaccgcccctacccacaggcccagagaaagccaagagctgcccctcagtggcgagcatgaccctggcaggctcatcagccgcagtgaggctttcaggggaagatcagcaaagtaaagtgggaggcacgatccacatccaaggcggcccaaaaggagatgcagaggcttgaccaatactctggcctggctggcccaggacatgggagctgtagtccccaccgcccccacccaccctgggccctgtccctgggctacagcccaacctgaggtcccgaccctcccagcgccagaacctccctcggctcttgggacccacactcactgaggttcaagggcccctcatcctcagactgaggccactgtgcctttggggaggccggccgggggctcagggacagctgggggctcttgtcctcaggattcttaggggtaggggagcccgccagggccagtggtgtctttttgaggagtggagagctgggcgggtggcccaggcccttggccgagaagccgggaggcgacttgatggctttgttgacagcaggggcatccaagggcttggccaggctgagcaagccgggccggggggccccggcgaccacctccttcagtgagctggacttcttagccaggcctgggggcagcccaaggtgggcgtcaggcagacccttctgcttcacaagctcgtagaggaggtcgatgggtgcgccgctgctttccgactctgccactcccagctgccgcaggtgggagcgcgcgtggctggacaggccctttcgggtctcaaagcaggcaccgcagacctcgcaggtggtcaggctctgggctgaagggcaacacagaggccgggagagcaggctgtgaggcccacggcccagctctcccgcttctcctcccctgagagtcccactcacccaggctccatggaagtgttttgcctccgtcaggccccccaaacctcacaatgaccctaacaacgcagagaatagcttggctgctttgccaataagggttagaaactgagactcagagagggaaaagttgtgcccaagggcacacagcaggagatagagcccttctgtcatccagccagtgggacacctttcacaacctttcaggcctacggggtgccctggcaacaggttcacacaaacgctgacctgacagccacatgcctcactgaactaagttctaaccaccctctgtggctcaactcctgcccgaaacactggtccttgcagtctcctgcaccctcttccacagagcctttatccttgcctatctgcttctctgtctccccgttccccaacttgaatggccctcaagagcaagggccaaattcattttgctcctctcacctccctggagtccaccccagggcccgtcactagtcaataacaaccttaggatc

SEQ ID NO: 36 - DNA, 1961 bp, Artificial Sequence
  Based on Homo sapiens sequence
agcctcatcctactgccttactattggtcgtcggcaaccgctttgttagttaattggagagactggatgtccatcagggtcacgcttgcagggcaacgagaggcaaaacaagagggaagacgactttcctcctgtgagccaatgaggccagctggactacgccgagacaactgggagaggcgcgggactcgcccgttccgcggaacgccgggaaggggtcacctcctgatgaagtttccggttccggtgtcagcggcggttgaattgccatggcaatgcggtgggcgcgcgcttgtcgtgttggtctcttgggaggtagcggggctaggccgggcgggtatccgcctctcccagcttaggtgagcgtccccgggcgcctccggagcgccgcggccgcatgcagttcgtcgtggcggggagccggagcctgaccggggttccagcgctcgggccgtagccttggctcctggactttccctggctccgccgccacgtgggagctgaggctctggggcttccgcctccggcgcgcgattatttctctagaacagttttcatttttaaaatttgtaaagcgcttttgcctgtgtgatttcctctgggttttttttttttttcttcctttttgtagagacggaattggcggcgggggcggggggtcgatgtctcacttttttgcccaggctggtctcgaactcctggcttcaagggatcctcctgcctcggcctcttaaagtgctgggattacaggcgtgagccaccgcccccggccgcctctgagtttccagcctcgttggccctccagccttttaacctgttgggcctaggatcaggaaaggtttgttgaatggggaactaagaagtgaattcgttcgttcgacaaacgtttcctgagcagccgctgggtgctaggcgcagtgccagcgcggaatgtccagggagacctggtgcccaaagcttggacccatcgtgagaaatgagaagcagatacaaagcagtgtgggagtgcagaggagacaaagcaagcctcatcaggcccattgcttgctctgctctcccttgtacttaccagtgcttgacaatatacagttatttactagcttggttattgacttcctacccagcactcagttttattcactgctgtatcctcagtgcctaggacgatgcttggaacgtggtaagtgctcctattggcgggaagaataaatccggaagagcaggaccagtggacttgctacataatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagttacttttttttttttaaactttgagtatttttttacaatgttgctggaggtgatctgtttatgctttgagagtgttcgaatttaaaatcagaaaatcatgtcagtgagtgagtctttcaaataatccttcggcatgaaacctgagcctagtaaactatgaaagtaaactcggcacattacccgaaagtctcaatgtcatattttcacccccatcaatattattgatgattgctcattttctaatgtgggacctgaaatttaccaggtgcttaaagaatctttttgtttttcagattcattgattccaggtaaatcagaggaacaagcaacatgaacagaaatatgtagaaaaagctattatgcagaagcataattgttgtttcagaagtccagcatctggtgcacttaacaatagagaatatattaaactctttccaaaataa

SEQ ID NO: 37 - DNA, 7058 bp, Artificial Sequence
  Based on Homo sapiens sequence
atttaggcggtgacagacagcatccgcagtcaataggaagagctgaagaattctttaggtctcccaaaatggtcagtaaggaatgacagctgggaggaggcggggcaagctagagattaattcgccccgtcagccaatgatcgtgttctcccactttggccacaggacaggaaaatagatagctgtctcagccaatgggagcatccaaagggcaaagatgctgccagcaggcggtgccagcccagggatagtcggtgacaaccggagacaagccttatgggagggtgacagctggggacagcacggagaaggggcgggggcattagtgcagccctcaaccaatgagtgccgcgctgccccctctcgagtcctttccggtcccctattcttcgttcagctcctgagccccacactctggtggtctgtgggaccctgagccccaccacagatccagtgccctgacccagtactctcatcctttactctataattctccgatctcggcccccaactaaccccaacactccaggcccaggtggcaatagccagagcccccagatcctataagcaacccatatctctgcttcacccatttcctgcgggaatcccaacctccaagtccctctcctcagttcccatctatctgagctcctccccagaacccaggctccagttcctcagaccttatccctctgagtaccccctccatttcttctagtggggatctcaaaccccaaatccatgaatccctaataccatgaactccccatatgtgtgttactattcttttggggatccaaggccccagtcccgtcaacccctctcccctcactgccacatccctctgtgctcctcatgttccactgagaatcccgacctcaatctcatgagcgctccaggttgtccttagatcacaagcataaagacctgacgttatgagctccaaccttccaacttctaaacgccctcttctttctctgacccccatattctgatttccatatagcatccaccatcctggaattccagtgagacctagctcccgacttctcagctcctccttggtttctgagtcctctaaggtccctcactcccaactcagccccatgtcctgtcaattcccactcagtgtctgatctccttctcctcacctttcccatctcccgtttgacccaagcttcctgagctctcctcccattcccctttttggagtcctcctcctctcccagaacccagtaataagtgggctcctccctggcctggacccccgtggtaaccctataaggcgaggcagctgctgtctgaggcagggaggggctggtgtgggaggctaagggcagctgctaagtttagggtggctccttctctcttcttagagacaacaggtggctggggcctcagtgcccagaaaagaaaatgtcttagaggtatcggcatgggcctggaggaggggggacagggcagggggaggcatcttcctcaggacatcgggtcctagagggagcgggaggagaaggagatggttgtccttgccaacttggggcttcctcagccactatttttccagacttctgctgcatggaggggactgggtcactgaggcccagagggagaagagagggtacatcaaagtcacacaatcagccaagctggctcttggccagaataaagtgagctgccactggctatcaaggcacctcacagaaagtgaccagctggctgtccttttagggtcttttcctcccctcttgagttccagcctccacaccagtacccagagaaaatattctagactcatactagatcacatccttcttctgcatgaaacctttccaaggttccccagggtctccgtcctgtgcctggcaaaggcccctcaggggctggtcaccagccccatcacaattctggccacctgaacacttctgatcttccgctctccaggcctttgctcaggccatgccctccgcccagcacatctgctcctccacctgcacctgactccctggccctcgtgaagccactcccatactcctagacagggctgctgcgccctccacttctgggctcctgaccagctctggtatgtcagtttctgcattcattcctgtctctattagttataaggcaagttctgtgggatgggaactacatctcccttttacagaggggaaaccaaggcccagcacaaaacctgagaccacaaagcatcttgcctcaaaaaatccctcttggctcggcgcggtggctcatgcctgtaatcccagcactttgagcactttgggaggtcgagacgggtggatcatctgaagtcggaattcaagaccagcctggccaacatggtgaaacgccatctctactaaaaatacaaaaaattagatgccgggcacggtggctcacgcctgtaatcccagcactttgggaggccgaggcaggcagatcacaaggtcaggagatcgagatcatcctggctaacgcggggaaaccccgtctctactaaaaatacaaaaaaattaggcgggcgtggtgacacgcgcctgtagtcccagctactcgggaggctgaagcaggagaatcacttgaacccgggaggcggaggttacagtgagccaagatcacgccactgcactccagcccggataacaaaacgagacttcatctcaaaaaaaaaaaaaaaaagtagctgggcatggtggcgggtgcctggaatcccagctactcaggaggctgaggcagaagtatcgcttgaacccagaaggcggaggttgcagtaagccgagatcgcaccattgcactcccacctgggtgacaagagcaagactccatctcaaaaaaaaaaaaaaagaaagaaaagaaaaaaaaattcccctctccttgaagggaggtaggagacccacctgatccctcagcttccacagatggctctttctcaccaccctcacacttacacacacttgactatgaactccaccatgtgggggtggagggattgtgtctgccaaagtacatccacaaagcccagcctagcacgtggcacactgtgtgtgttcaatacatgtttactgggtttattttattaatttaaaatagagacgggggccaggcgcagtggctcacacctgtaatcccagcactttgggaggcctaggtggatggatcaccaggtcagaagattgagaccactctggccgacacggtgaaaccctgtctctactaaaaatacagaaaaaaaaaattagcctggcttcgtggcacacctataatcccagctactcgggaggccaagataggagaatcacttgaacaggggaggtggaggttgcagtgaaccgagatcacactactggcactctagcctgggagacagagcgagactgtctaaaaaaaaaaaaaagggagacaggggtctcactatgttgcccaggctggtcctgaactcctggcctcaagcaatcctcctgcctcagcttcccaaagtgctgggattacaggtgtgaaccactgcacccagacgtttactgggtttaaatctgagcccaccccactcaggggtacaggatctggttcatttatctcccagaatgatgccttgggttgcgtcccctctaaactctggcacattccagcccctctttgggagaaagaacatctcttcttgcccaggccctagtgagacatgcatcgcaagacatgctccccccttcctccccgctgggctccagctgctgccagccctccaagaaaggagaggccctgagttgggctattttggtatctggggtgggcacccgcagggctaaggttaccttggtatgttaagggctccctggggcaggactatataaccccagagggactgccccatgctgactccttgcttctttccagccggagccgctgccttgccccccggagactgaagacatggtgagtgagaatcctccaacccctgcccagatcccttagacctcagggcagcctcaccctttgaaagaaagtagctggttcccagtccaacaaaaagttaaaaggatgctcatctctttctcggcatcactgatggaaaacagactgtgtgatggcctaaaggatccaatcaatgataatccgcccagacattcaactcacaggggcccagtccctctcaaagcctgatccattcattcctgtactccatcttcctaaggccctctggcaccagccaggcaataactcccatcccattttacaaatgagaaagtagaggctcaggccaggtgctgtggttcacgcctgtaatcccagcactttgggaggccaaggtggttggatcacttgaagccaggagttcgagaccagcctggccaacaggcgaaaccccgtctctactaaaaatacaaaaattaactgggcgtggtggtgcatgcctgtaatcccagctactacggaggctggggcataagaatcgcttgaacccgggaggcagaggttgcggtaagccgagatcgcagcaccgcactccagcctgggtgacagagcaagactctgtctcaaaaaaaaaaaaaaaaagaaaagaaaagtagaggctcaaacagggcaaatgagtggctggggtcacacagcaagtctgaggctcagaggagctaggctcaggacactgagaagataaggaagcttccacccattgtgggggatggagagttggagacccaggagccacagacgggaatttggggaatgcaatcaaagcaagccccctcagcaaagaggtcccaaggaaggggagactcaggccaaagggctgctttaggaacagggactcgaagaattctgactcttaatccattgcccccagagaggtggagggactggtccatgggcccctttgttcaaccctcaccctccaggcacccaagagggccaagagaaggacagtagagggcggaagctccagcgtcttctccatgttcgaccagactcagatccaggagttcaaagaggtgggtgaggggacggggaaactggaaggctgaccaaaagcagccctgctggccctctccctggaatgtgcacctgcttgaaggaggggaaaggtttagaattccttcctcccctctctgcttggggtggaagaggacagttggctgagagccagcatctgatcctcctggggtagggatgctgaggctgggccatgggggacctaaccctccccaccacggccctccccaggccttcactgtgatcgaccagaaccgtgatggtattatagacaaggaggaccttcgggacaccttcgcagccatgggtgagccccctacccccaggtgggaatattcaaggctgcagagtctaggaaattcagtggccttgggttccagccctgtcagctccaccttgggcctcagtctacccagctgaaaaatgaatgggatcagctgaattagtgggaagcgcaggcccggccccaggagcctgctccagcccatgcttcccccaaccccctccaggccgcctcaatgtgaagaatgaggagttggatgccatgatgaaggaagccagcggtcccatcaacttcaccgtcttcctgaccatgttcggggagaagctcaagggtgagtggagtgtcctgggtccaaggccccggctgccttttcccagacccttcagggacccatcagcttcatgtgccctctgacccccacaggtgccgaccctgaggatgtgatcaccggagccttcaaggtcttggaccctgagggaaagggcaccatcaagaagaagttgtaagcatcggctcccccacccttccgacccttcccccactccaccagctgctcccacactgacagcctccttaaatttctaccaaggctgggccctgtggctcaggcctataatcccagtgctttgggaggcagaggcaggaggatttacttgaggacaggagtttgagatcagcctggataacacagcatgaccctgtttctaaaaacttaactaaaaaattcgtgggctggccgggcacagtggctcatgcctgtaatcccagcactttgggaggccaaggcgggcggatcatgtgaggtcaggagtccaagaacagcctggccaacacggtgaaaccccgtctctactaaaaatacaaaaattagctgggcgtggtggcgggcgcctgtagtcccagctactagggagactgggacatgagaatcgcttgaaccctggagtcggaggttgcagtgagccaagatcacgccactgccctccaacctgggcgacaatagcaaaactccgtctccaaaaaaaagaaaaaaaaaaattcgcgggagtggtggcaaacacctatagtcccagctactccggaggctgaggcaggaagatcccttgagcccaagagttccaggttgcagtgagccgtgatcaaaccactgcattccagcctgggcgacagggtgagaccctgtctcaaaacaaacaaaaacccaaaaattcctacgaagggttaggcactgccagaggtaagggagtagttaagattgtggtaatgggcggtaagattgcattttcacagcaaatgtgggcggagagggcaaaagcgagtgtctgggaggccaatgaaggaagtagagtgacctgggttttcaggggaggctggggctggcatcggggatgaggtgcgagggagtggaaaggaaccaggaacccaatcgcaactccccttgtgtcacctctctccagcctggaggagctgctgaccacgcagtgtgaccgcttctcccaggaggaggtgagtggggaccggggcggggccggagcagcaaaggggctggggccggggagactaagggcctgtgcgagacgcccctacgtctttccccagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 38 - DNA, 121705 bp, Artificial Sequence
  Based on Homo sapiens sequence
atccggaagagccgccggggcagggaagttgaggcggtgcgcggcccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccagtaagtgatagccgcctcctcctttcgcggttatgtttttctccagttcgtcccaagtctcgttcccgtctcattacttcaaaaactattcaactccgggaccggacaggcacgggagctgcccgggagaagagccccagaagtctcagagactgccaaggtgttgtggggcaggggctgcgtgcaaagaccctgtgaattagaaagtttggaaagcatgcctccaaaaccgagcgactccacgtttgccaggcgcccctggggcagccgagcggcccggaggcgcgaaatggcgcgcccccgcagtgagaggggcggagggagtggggcggggccgagggcgcgcgtcccgccagcccgcgcggagggggcggggctcccggcaggtgcaggcgggcggggcggggctgccgcgattcccggagacagctgggggatgccagtgcagttaggcactctcctgtcttcttttcgacgcttcgctgtggtcaagaggacaaagtaaagcaaatgattttattttgaccccaaatattcaataagaaaaggaaagagaacttgaaagttgtgaaatgacccttctcaaaacaaaaagtccctccagtgtctatctgggtgggtagtaggtacgtttattgatttagcaaactgctgataacacagttgattagtcagttttgcatagatgttgaaagggaatgaataacgatggtccatataaccatagaaatgctagcctaactaggcaaaatttaatctgaccttaatttgaacgttgaattctgctgctgcccttttcctgccttgtgtggagctgtttttcaaattgctaaatttgtggctctaaacttaatatgctttaatagaatcatagtgattctcttgtagccactgttgggagtccagatttttttttttttttttttgggcaaagtccacattgtggagatattccttcccaagtgctttttctgctttacacttggctgaatttatattgcttaaccaaaaacaaattaccgtggaggccgtaatttatttccactcattgttttggatatacatttactcattcttactctcactctggcctcctatagtggtcaggattcttgacctaactgctatatgtacttcttaaacgtttcacaccttgcggaatagtaggttctcagagaaagcaaaatatagcaaatagcgtgtataacacgtacttaggatgataaactgtgaactttatagcagtctcctttaatattcgtatttgtagagtccagtacaataaatgttggacaaatgaagtaagtcaaatttaagtacacctcttctccagtcctcaatctctttccaaacgaaataagtgtttctctctttttttttttttttgaggcggagtctcgctctgtgcccgggctggagtgcagtggcgtggtctcggctcactgcaagctccgcctcccgggttcacgccattctcctgcctcagcctcctgagtagctgggacttcaggcacctgccaccacgcccagctaattttttttgtatttttttttagtagagaacgggatttcaccgtgttagccaggatggtctcgatctcctgacctcgtgatccacctgcctcggcctcccaaagtgctgggattacaggcgtgagccactgcgcccggccccaaataagtgtttcttatttggacagctggtttctaactgtccagtgctacttctgagatcgtcacctcatttaaatttaacctccctctcctttgactcctattcatattgcatttttgaccactggtagtgcactgtttcgttttatttgccccttggatttctgaggacatagagaaccttttactatacttttcatttgccagcatagtgccttgtacatgatagatattaggaaatggacattgaattgggtttatacatatgtaatttgttatccgtctgtatacatgaaactagaatggggataggtgctttttatctgtagatacatactttttaatagagtgccaggggaatgagataaagtaatggtatatgctgtatttattttcaataatacttttttattatttgaagactcagtgttttttcaccttcctatgtttatctgttttctttgcattgttgacagctgtttctgcagaacccagtagatttcctacggtaagaaagagaaagaaggaaacaaattcacttccaagtatgaatttctaaggacagtctgttaattattcatgtcagaactggctgtcagtctgattaatggtatgtgtttcagttacatagcagaatacacatgagtgtgtgtgtataactaaagagagagagagcacacgaaagaatgacactgtgttcatataaacaaaagctagaaccaggactcttgcaaagaactccactgttactgacttaagccaaaagatatgtttcagattttatacttgagagcaaatgtgtgtgtatggaatgtggcctcttacatatattatgtaaaataaataccattatatgtcatttaatgatggggatacagtctgagaaatttgtcattaggtgattttgtccttgtgtgaacatcatagagtatatttacacaaacctagatgatacagcctactacacacctaggctatatggcatagcctgttgctcttaggctataaacctgtacatcatatcattgtactgaatactgttcgcagttgttgtaacacaatggtatctatgtatctaagcatagaaaagatacaataaggatacagtattgtaatcttatgagaccactattataagtgcagtccggaaatgttgttaggtgcatgcctgtatattaatgcagggttaatatgaaggaaatttggggaaaagatgggaaatgctttgaactattttggattttgataatcagtaccaacatagttctttgacttacatttgacttcactcatttttgaagtacatgtactgtgactgtaacagataattcagatttcattaagatttgaattcagatattattttgtgattatagtatgacccaaagccagtgtgatttataaccaatcgtttttgttaaattgtgtgtacatcttgagtatcaaatatataatatgatccttttttttttctttagttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtaaatcacttaaggattttactgccatgctatcttctagaaagattttgagaaaatatactagatttagaacactaagaaataattgatatttatacttaaaatatatatctgttgtgtagttgatggtcacttcttttagagcagaataataattgtgttctgtgggcatgaagtatgagtcttgcccactgaggggagggagaatgtgtggagacagcagtatacttgtgtgtctatatatttccacgtctgtgtttaaaaatgtaattcaaaacagctttatgagcttttgtggttactaacaataaaggaactggtaatacaaagaattagaaaagtgatagatcttgtccagggatcttcagaactattttaggacattagttatttttaaagatcagtattagcattgtgcagtctacctaccagttactcgatacatttttgttgaatgcatgacagataaagcatcttaattgttaagaaactgcagtggagcaatcagcagcttggggtggcaaagctgtatccttgaattcctgcctctaggagtccttgcccctcactttctgttttaaaagtgattttttagtaggatggatagagttgacttaagaattttagggaaaagtgacactatagtgtaacaatttttatttagttcattgcatggaagtaatttcttggaaggcatagtgtggcgaaagagaagaattggatttaaaggctacacgcctaacctgggagacttagtaagttattttatctcactgagcctcagtttcttcacttgcaaaccacttctagagtccctgtcaaccccctaattaaaacaaaatttaactatgccattattgtataaattaataaaggctggtacaaattaattctatttacatgaaagaaagatttggtaaaattaaaagcaggtccagaatattgagggcagtctgtgattaagttggagaacatacatacccttttgtttaaaaataaatatttagcagccgggcgcggtggctcacgcctgtaatcccagcactttgggaggccaaggcgggcagatcgcaaggtcaggaaatcgagaccatcctggctaacacggtgaaaccccgtctctacaaaaaatacaaaaaaaattagccgggcatggtggcgggcgcctgtagtcccagctactcagaaggctgaggcaggagaatggtgtgaacccaggaggcggagcttgcagtgagccgagatcgcgccattgcactccagcctgggcaacagagcgagactccgtctcaaaaaataaaataaaataaaataaataaataaataaataaatatttaccttatagtacatttgagaagagtggtgatttataatcaataagaatgcttcctgaattccaaaaaggtttggagtcactatagtagaacttcttggaggcaagttaagattcccaaaaagaccaaatacttaatttaaatgaaaaatattgtctgcagttacacttgctaggataaattatgaagagtattaatcattatgcatcagggtactagataatctcttgatgggatcaagaaaaagggtcccccccatcagccttttttaaaaattagagatggagtctcactctgttacccgggctggtattaaactcccaagctcaagtgatcctcctcctctggcctcccaaagtgttgggattatagatgtgagccatcgtgtctggccaatgtttcctattaataagtttgcaaaaggattattaagggggactttagttaatgttgtcgaaatgctatttaggaaatagttttaggctgccattattttcagatacctttccatactgagtttaagtaatacaatcctgtctgcctaagtgaccctatcagtttcaggtgaatttagcttattttttcaattctctgaaaaagtaagttacaaattatgttactactgaacaaaacatcagtaggcatttgctaggatcttgggaaaccaaaaagaatatagtttttccctcctttaaaaaactcagggctgtatggcagacagctatatagtcaaatatttaccagatggtgtatgcatgcctacagatacatgtgtatgtatatattaagcattattgtatgggagcttaatggaaacttttatgtgtgatgcatgcctcactcaaggtatgttgtttttgtttttgagacagagtcttgctctgttgtccaggctggagtccagtgatgcaatcttgtctcactgcaacctctgcctcctgggttcaagcaatcctcctgcctcagcctcccaagtagctgggattacaggcatgtgccaccatgcccagctaatttttgtatttttggtagagacagagttttgccatgttgctcaggctggtcttgaactcctggcctcaggtgatctgcccaccttggcctcccaaagtgctgggattgcaggcatgagccatggtgcccggccagaattaatgtttaaatagcgcttgctgtatgccgagtaatattttcagaaactttacatgtatgaattctttttttttttttgagacagggtctcactctgttgcccaggctggaatgcagttgcacaacaatcatagctcactgcagtctctaacttctgggctcaagcgatcctcccacctcagcctcctgggtagctgggactacaggcatgtgccaccacactcagctatttaaatttttttttttttttgtagaggtggggtctctgtgttgctcaggctggtcttgaactcctagcctcaagtgatccttctgcttcagcctcccaaagtactgggattacaggtataagctatgaattcttctagttttcttattaccctgtgtgataggttctgttgttattttatagatgagaaatctgagaggttacaacttagccaaagtcacacagctagtaagtgacagagttgtgactcaaacctaagcattctagcttgagtctgtattctttgtttttttgagatggagtctcactctgtttcccaagccggagtgcacaggtgcaatctcggttcactgcaacctctgcctcccaggttcaagcgattctcctgcctcagcctcccgagtagctgggattacaggcgtgtgccaccacacccggctaatttttgtatttttagtagagacagggtttcacgatgttggccagcctggtttcgaactcttgacctcaggtgatccgcccacctcagcctccccagttctgggattacaagcatgagccaccatgcctggcctgagtctgtattcttaaccactgcattgcttcttagtgtgggcatttttgaggagcagagtgaagaggagagcactgagacaaagggagcactgtatgtgaaaaagtgcgcagaagtcttgatagaacaggaagccagtcacaaaaggccctatagtccagtccagatttggtaccttattcttagatctgtggcaagccatggaagggtaaaagcaaaggagatttggccttcattatgtattgctcaggttactctagaagcaatggggcatatagtgttttattcttccattctaagatgctatttacagtaagaaacactatcaaattaaagatagctttctaggaataaaactacaattaaattacacagctttgttgttaaaccagaatttgtttttaagccaaaaataacaagtgtctgtctatacagtttatattatgtaagacttcattgatacatcacttcatcacattgaaaatctaaagacttctctttcttttcttgcttttttttttttgagacaagagttttgctcttgttgcccagtctggagtacagtggcacgatctcggctcactgcaacctccgcctcccaggttcaagcgattctcttgcctcaccctcccgagtagctgggattacaggcatgcaccaccacacctggctaattatttgtatttttagtagagatggggtttctccatgttggtcaggctggtctcaaactcccaacctcaggtgatccacctgcctcggcctcccaaagtgctgggattacaggcatgagccaccacgtccagccaaaaatccaaagacttttctaaattatgctaggcagtctgtaatctcattgggcattcttcaatcatgcataacgtcagagtaacaccacattttctgtaatgtggttctcctgatcttagtttttcttgttttaatatactgactatataatttaaactgaacaatcaatttgcatctgaagcagaactgagatgaggggactagaaatgggaggcaaaagtgatatttctttagggccaaggaagagagaatgaatatttcagaaacccaaagaatttttgttaaagcaaattttctttacctattttttttctattctcctttttaccttccttcgtagaagtaattgttggtacattctgtttatatttcgagaagcaaattgggttaattatcatatttcccactcgagtatccttctgtatatgtacaatagagagtacttagtgactgtttgcaaacataaaaataaaattatttaaaaaaattattttaataaccatgtgacccagcagttctactccttagctgtatgcccaagataatcgaaaactgttcaaacaagaatttgcatacaaatgtttgtagttgcattattcataatagccaaaaagtggaaacaacctaaatgtccatcaactaataaatgaataaacaaaatacggtatatctaaacagtggaatattatttagtcataaaaagagtgaagtactgtatatgttacaacaggaatgaatcttgaaaacattattctaagtaaataaagccagattcaaaagaccacatattgtatgattttgttcagatatccctgacttacattttttgactttatgagtatgcgaaagtgattcagtagaaattatactttgagcacccataaattattctgtttgtcacttttagtgtagtattcaataaataacatgaaatagtcaacacttaattataaaataggccttgtgttagattattttgcccaactgtaggctaatgttagtattctgagtatgttcaaggtaggctaggtaggctaagctatgatgttcagtgggttaggtgtactaaatgcactttcaacttacaacattttcaatttacgatgggtttattgagatgtagccccattgtaagtcacggagcatctacgtgtgaaatttccagaataggtaaattcatgaagaccaaaagtagatcaatggttgccagcagctagggttatggaagaatggggagtgactgctactgggtacagggtttctttttgaaattatgaaaatattctggaattagtggtgatggttatacaatattgtgaatatactaattaccactgaattgtctactttatagggtaaattttatggcatgtgaattatatcttgcttttttttaagtattcatattttttttaaagtattcatgtagggagcaaaataaatgtaactgagaatctacaagcagtgttaagatgtattacaatatatattccagttaaggccaggtaaacaagagagagagatttctgggctgtttcttgttttttaacattctaggatatgaacgaaaagtgtgtctcccttaatggcaaaatgtgatgcaatctgaattaatgtaaataatgaatatgttcattagaaaatgggcaagtcagtcttagaagcatagaaaaaagagtcataggggcaaatgttggcaatggccaccttgtttgtctatacactctacagtgtatggagagagaatttcagccaaccaacagagaaaattcaagtctatctgtagacttgtaacctgtaacagtaggttaacatagcctggcaccttaaacattcagttactctaatttgctttttcccctcatacttcctaaactaccttctgattggctttcagaatagatgtatcaactaggagaaaatatgctgaccatagaaacttaaggtataatgattcctattatggcatttctcatgggctggacaatctgatggatgggccttcagtaggcgtacctacctggtttttgaaccgctaaatactgaggacaagacaggagacatgaaccggcataacagttgctatttcaataaacctgttaggaattagcctttatagccagcatctttccaccccaatggtgcattgtagccaaacatgagaaaaagggaatttccacataagattttcctcctcccctcctctccccttttccccctctttttctctttctccttccctccttccttcctccctccctgtctttctttttttttggacagggtcttcctctgttccccaaactggagttcagtggagtgaccatggttactgtagccttgaccccctgggctcaagagatcctcccacttcagccctaccgagttgctggggctataggcatgcaccaccatgcccagctgattttttaattttttatagggatggggtcccactatgttgcccaggctagtcttgaactcctgggccccagcggttctcctaccttggcttcccaagtgtgagccacggtgcccagcctgagtaagaattttctttggcattttgcaccttttctgttgcctgttttttaatgttgaaaaacacaaggcttttataggataaggtgatgctgcgggtaaaccgctaggtaagtcagggctcaaaaacactgtcatatttatgtattaataaattctgagtctgactgaaaaagtaactttctagcgctgtggaactctgtggtcgtcatgctaccatctctttatcggtctgctgcgtgatttactaaaataatcatcagttgattttatctgtggcaagtggcaatatattttttgttaaatgccgttaaaattatatactttagatcctactgagatagccctcttgtgagaataagtcctttttaaaatcctggttattataacttctagctatttgctttaaaacatggtctactcattgtgcagtatctggattaaaaaaaaactctactgataactgttatttgcaataattctttatattttcttaatagagttgatgatctgattttttcttagtaaaacacaatcttttttttccccctgaaattaaaatttatctttcaggaaataggagaagaatatatcccttggagtcaaatctcaagattgaagttgatgctgtttttttgttttctccatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggtaaataatcacataaacgagataaataaatttgaagaagtgtttttcagctatgggcacattgggaggattagggaacacagaatggatacaaatgtacttgtgttgtcactttgtggaagatcaagctcgaaactgttccacatatatctgaatatagtctttagaaaccatgcaatcatcctttttaggtggaacattgacaagaaagtagtgaaatgacttaattatattaaaattaaagaagtgaatatttaagaagtccaccctagctgttcttaactgaagaatagaagaaaattaatgttcttagctaagggatagaagattaattaatgcttaaatggttaaacattggagtggccaggcatggtggcttgtgcttataatcgcagctactcaggaagctgaggcaggaagatcacttgaaccaaggagttctgggtggcagtgagctatggatcatgcatctgcattctagcctggttgacagagcgagaccctgtctctgaaaaaaaaaaaaaatcacattggagtgaacaagatatggagtttggacccactcttatttgctgtgctaaatgaagtatttgtaaacactctttaacaagtaagagtgagcctgattttcatttgctcgcagcttaaacacaaaggtttattcttacctaaaataattaagagataggcagttcaaggctagttcactgttgagaactcagactcctgtctttctattcaaccattcttttctttgctttttttttttttttttttttttgagatggagtttcactgttgcccaggctggagtgcaatggtgtgatcttgactcactgtaacctctacctcctgggttcaagcatttctcctgtcttagcctcccgagtagctgggattacgggcgtgtgccacctcgcctggctaattctgtatttttagtagagacagggtttcacgatgttggtcagactggtctcaaaccctctaacctcaggtgatccacccacctcggcctcccaaagtgctgggattacagatgtgagccaccacacccggcctcaaccattcttaatacatggcttctcttctgatgattggctgtgggccaggatgctggctacaactccatcacatgtgtgttgtagtcagagaacaataggcaaaagtgcctaccacctaaccaattctccacttaagaagtctcttgcattgtctgcttatgatatctcattggtcagagttctatcatatgaccatacctatgttcaatgttcaagggagcctgggaaatacagtctttgtattaggcgcatgtccacatggaataaaactagggttctgttactaaggagtaatcatagggactgggtgatttgtcccaggtcttttgattagcgatcaggaaagaaatacccctcttttctagataaagttaactttgttattaaatttagtagttggagcatacgtttactttgaccacccgcaaggtagattatatagatcatatttggagatattttccatatgtgtattttatttagtgaattcttaaattgatagtagacatagttttcaagaaaaattacttaaatccccattataattaaatcgtatgatataccagagaaataaaaatagtaatttcaagtactgctagacttctggatacttaacatgtatttaagcatactcagaatctgttttcttttctttgctaggttcaaaggctatctgttggaagtattccacgatctatgaaggttattctggaagatgacttagtggatagttgcaaatctggtaagaagaggggaatttttttttagcttgtgtaggtagtcctaaagtattgattaggaaaagccactttttattttcccaagatcactggcaagggaaatgtagagctgtaattgctcaccttgagattagaaactggcaggtgggaagtgatagcaggaagagagctgggctagatctatacaacagcagctagtccaggtgcttgttttatgaatgaagaacctgacttgtctaaggtcacttagagagttaagtggcataactggaacatgaatccagaaccactgatgtctaatttaaggctcttttcagtgcactatagcttaacagcaggaactttaaaaaatgtagtgaatttaatgggtatttttataaaatgaattagagaatgtgactctgttaaatgctgctgcgtgtcttattggtgcctagaagaaaggacatcattcctctctgctctgtgctggtgacaccgtgattggagtcactgattgtagtctgctgtcttctgagggtcctcaatgttttcattggccgatacctgaattgggagggtacttgaaacccatactcaatgaagaactatacatggttagcatggagaaccctgaggaaggacatgacagccaactttcaatagttagaagactgtcacatagaaatagaattgtaattacagaagttgctgttgggtttcagtggggtaagccacaaggaggtagattttgactcaatacctaataattagaggtgtctaacatgggccttagatggtgatgagttctttttctcatagacaatcaagcacagcatatacagtacattgttagggatttaggccctacagtggcagttgatctggataataatctgcaatgttccaggcaatttaaagactttctgagcctcagaactgttctggaaatctgagagttccgaaagcctgattgttccagtgtcattctgagcttatgctttactctttaggctaaccagactggtcctgagttctcctttgtccctgtcaactcatcatgttccctctcctcactggggagactaagaagaaatcaaacttaaaagtatttgtggaagggtgatgttttagtcattttgggctgttagtccattcttgcgttgctataaagaaatacctgggacggggcaatttataaagaaaagaggtttaattggctcacagttccacaggctgtacaggaagcatggtgcagacataggctcagcttcttctgaggcatcaggaagtttacaatcatggcagaagggagagggggagcaggcacatgacatggtaaaagcaggagcaagagtggggagggaggaggtgccacacacatttaaatgaacagagctcattcaaactcagagtgagagctcctttatcaccaaaagggtggcccaagccattcatgagggatccacctgcatgatccagacacctcctaccaggcatctcctccaatactagggattatatctcaacatgagatttgaatggggacaattatccaaactatatcaggctgctctaacaaatcaccatagactaggtgggttcaacaacaaatatttatttctcacagttttggaggctggaggttggagatcaggatgccagtgtcttcggattctggtgagggacctcttctaggtttcagatagccgacgtatattaacgtacagttgtgtaaatagtatactaatgagataacagctttgattatggattgcctgctaagcaaccccagaatatgtcaaaataccttgctcatataggactagattttaacctaaatctgtaatatctgtctcagcaatgcagttcttatataagctcagcctgaacatgaaaatatccatcaattgagaataagatcttttcatgcagttcatctaaactgaattctttctgtactggaaataagtcttaagttgtttttctttcaaatgtcattaataatgaaggatggatagaagcaatctatcaacagctattttttcatgtatcattagctataaacctctgtgggaatcaaaagacaaatagtatataatccttgcccttcaggaatttacgatctagttaggaaccccactttggcacatgcagagtaatgaagttggagggtgtgtgctggtaaatgtcagtgccacaggagatccgagagatgggtctgactggcaatggctacagtagtaaagatgccgcagatgatataggggcacagagagactggattgtagaaaagtaagaattttagcttcctgaaaataacattgcttataacattagttttgaaaaatacagaagtttaaggtgaatatctgttgtcttggactatcatgtatacctcacaattgttctggtgattatatgaatctgccattcagtaattatttgagtaaagaaaacacgtatatattgaagggcttttaaaggtattaattactttacaaatgtaaggtaggtttagtataagaagagctaatatttactgagcacttgccgtcttctagatactgcattaagtaatttacgtacattatccgatctaattctcattatagtactgtgatgtaaatataatcattcacattttgtagttcaagaaacaggcttaggaaaggtaggtaatttgcccaaggtcacgtagcctatgggcagtggagctgggatttaaatccaaatctgatgaggtcagtactcttggccatgcttcagtgctctgtattttccacataatcactgcttattgacattagattattacttacgggtcatatatctaaacattaagttcctcatttaactagtttagaaacaacctaaacataatccattaaaatgaccataatagagaattgttccatgtccttatgtaaagttgcccccaatcatttttacctagaaatttggggtcagacaatatagtaaatgatcatcattcctgattgggtttgaaaatcattaagtagtggcttaggaaagatcttggaaacttgtaaagcacttacttaatgtgtttgtaactatgtagtatgaagttgccttaaactagaaatgtgccttctattctgtggattggcaccaccagttccatgaatttagcattttcctttaggaaatcaaaagctatgcagattactcattgaaatttagagagtgaaaggcatttttcatcagcacatatcatataattggcacaaaggcttggaaatgaagaattgcctgttagttctgagacagtgtttattatgcaaaatataaataccagaattggggttggggcacatccaacaccctgtgttcaacaagattaaaatttggggggaccaggattatgatttttttcatgtttgtttttggcccactttctccagtaccaaaatatggaaggccaaacatttgtatatacttgttaactgatgcattgcattgtatgtcgtaacaagtacagatggcagtgtttggcgagtgtgcctataaactacccagggcctcttaggaaaatctataaaagttgcttctgcctaccaggaatggtgggagggtttcctcaggtaggagagaaccatcagcaaggaacaagcaggattgtatcttgtgcttttatattttgtgggaaggaactttgaagcataacaggcatttattcatttcttagttcattgtttctttggttcactaaaaaagatgtgggggggcagtgagtaaaatattagcaaatgagttaagtaaaaatgaacatgtaagaaacccaaactacctgccagtcatcacaaggttatctcttttcctgactccaaattatagtttaaccttctggctgcagttcccacatctcttctctaaatgagagctaaatggttagagactcagaggatgaacatttcatccaatgtaactgtgatgaatgaatcatccagtaaactattttcccagtgaaaagtaataattttgtaggattatcatgtagcaggttatgaaaaataggaaatactgacttcagcttttcactttacagatacatgactgtgggggacaacagtcaagaatctggggtgctattctgcccctgaattgttttctggatgagtgtacatattgtaaactctagtaagggagtggtttatttctaatttctggtcctttgtcattttgagtctgtgctcagcatgcaggatgctactgctggactcacttgatgctttttcctaggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggtttgtgtttaagggctaaaactgattattattaatggtattacattcagtggttaaatatgatgtctgtgatttgacagtcttatatgccgcataactcaatgactgagtttaaagggtaggattagtcattacctctagctatagtctccctttgaagcctttttctgccatactcttctatttagcaacctgcctggagatatttcatttctaactattattttaaacaccttatacactgccaaaacaatttcagagtttcctatcatatcaattaaaaatatagttctttaaaaaggcaaaactcatccttttatgaaccctcatcctattaaagccattgtttttctttgatgtattttcaataataaagatctaactctacactattttggctgaagattttaaaacagggaataactaggaaaaagatgagagaagatgcagacgataagctttgtcatcacaagcaaaaattttgactgtgacattcaggtgtaattacatagaataaaacatcacagccattgggtttgtagtgtattttattaaaaaatctcaagtgtgtaaagcaccaattaaatcttcaagtgcctgttttcatttctccatggagacatcttttgagaaaaataaactgaagccagtaatagacgtttctaataacactcccctcaaatctaagagatattgattactttattcttaaatcacatgctaaattagatagatattattttaaaaaataaggcttctagctgggcatggtggctcacgcctgtaatcccagcacttggagaggccaaggtgggtgggtcacttgaggtcaggagtttgaaaccagcctggccaacatggtgaaaccctgtctctattaaaaatacaaaaattagccaggtgtggtggcgttgtctctattaaaaatacaaaaattagccaggtgtggtggcgtgcacctgtagtcccagcaacttgtgagggtgagacaggagaatcacttgagcccgggaggcagaggttgcaatgagccaagatcgcgccactgcagaccagcctgggcgacagagtgagactctgtctcataataataataataataataataataataataataataataatgcttccatttccctaaatagggatagttttattttatgggattttttcttttttcttttttttttgtgtgtgtgtgtaaatgtatagcacattagtagttcctgatctttcttttttctgatctgtattgaaagaagcaaaagttctctacattatagatttatgaagcaggcactttaagaatcatacatttttaaatgatttttaaaattaaaatggtttctttttttttttttaaagtagacagggttctcactatgctatgtttcccaggctggtcttgaactcctaggctcaagcgatcctcacacttccgtctcccaaagtgctgagattacactgtgcccagcctgaacagcctgaaaatggtttcttaggattctatccttataaaaatttgtaactcttccttggaccactgttatttatttatttattacagtgtcacagctcagttctacctcttaacaatgaagggaaggccatcatatggtactctaactagatcttcagacgtgctttgtgctggcaattaaagaatctgtcttgttttaattaggctactgttgcatgagccatttattggataaaaggcagaagtaaatataatagtcttgtgagaaatataagtaggaagatagcaagaaaataaggcagtgtttctcttgttagtatgaatggattctcagtttcctatggaccagcaccagtgtactggtattcctccatttcagagtgttggtgagtgtgttggagggaggagaggtgaagttgggaagctgtatccaacagaacatcttcattttgctggtctaaagctggagaatgcttcactgatcagcacttggaggttgacttgcttaagacctgatcctgtgggtactggctaggatgaacctaggggccttattctgatctgctgtcacctgagggattccttgaccctggtgcttagatgttagaaacccagatgtaagggttggagtgttttgggccatctgaaccctctttgggggtcactgacttatcttaattctgagattactaagggcctactaagttctcttcattgagataactgagggccacacaagagtagataactaggcctttgccacactattgacatggtctagaactagaaatttgggagggaggtgaggatgggggtagtactggtgctaatgcattttcttccatgatatagccatgagatcttctgctgccatgatctaaggaatcaagcttttcaacttagacaacacatttggcccttcctttttgcttctctctgggaccccagtcctacctttgtagtcttttgtgttgaccacagtgtgaggaaatctttagatcagaaagatgcacaaataatacaggtaataaaatagctaacagttacagttaagtagttcccactatatgccagttattatttaatgtgttgtatacttactaactcccttgattctcaacaattctgtcttgataccattataatctccattttgcagacaagaaatggaggcagaggttaagaaacttgcctaaggtcagacagttggtaattaatagcactgggatttgaatccaaacatgacaccagagcctgtcctcttaccacagggatatgcttcccatcagcatgttactcagtaaaattggctctaagttttggcttatgtaattcccagatcaatttgcctactcttgaacctgtttgttggggctgtttcttctttccttccacatgtaatcactagattctggtcacaatttacctacctgctgtcaagtcttatctgcttggattcctgaccttttctccaggctttctaactccaaacagggagggattccttcagcaagtaatgaacttcctggatttactaaatcttctggttccttttttactaaaagattttctttcttcaccatttctgccatcgcaggccacatcatcatagattagttgccactgaatcaatgttgattcattacaaaaagtagcctttgtgtatagggccataagtcgtggaaaggctcaggaatggcttgttggaattccataggttggttaggccaatgactgaatgaaatacctgctttattcatggaagagataggcagattctcagatttggtgcgttatttctgaaaacagaaccccaaacagtgatgttcttttatttaaagcacatgatcagaagaattcgagatctcatacttacactgctagggttgtggtgtgcagtgatcttcttaatgccttgatgcccctgtaactttgttccagagaaaacagaatttaccagactgctcagagcaaatgctgaattgacttggagggtggattttttacttatttcttatacctttggagcagcttcatgagctccagctacctctgtatttaaagattactgacttgtatgatctgactcattatttctgagattgaataccttccttttatttaggcagtggagtaattttactgaaattgtcacatagaaagtacatacggtggctcataccactcatgagtgctgggtggtaatcccagcactttgggaggctgatatgaaaggattgcttgagcccaggagtgagaccagcctgggcaacatagtgagaccacgttgctccaaaaaagaaaaaaaacattagctgggcgtggtgctgcacacctgctgtcccaactactcaggaggctgaggcagaaggattgcttgagcccaggagtttgaggctgcaatgagctatgatcacgccactgcactccagcctaggtgacagagtgagaccctgtctcaaaaaaacaggacattttgaaccaaaacaaagttatttcctcctttaatcctgttggtcatttggaattggacctcctgatcacttcacatagtagagtatatttaaatgaggatggtcagataggaaaggaagggaaatttcagttggggtttcttgaaaattattgctgatttctgatctttctgcttttcctaggaaggaatgtaatattggctagcttgtgccctcaagtgtttggaatgtatctagtaaagcttgctgtggccatggtgctggctggtgggattcaaaggactgatgctacaggaacacgggtcagaggttagtacctatttagaaattttgagtaatattgacacatggatggaagctagaactttttctttcccaaataaaaactgctcgttgggttttattttccaattgtaatcttataaaactgacagttgtctgaatatcttatacttagtctagcatctgtatatcagaagctactttctagagttccagaaagactgaaagaagttacatttttctatggcatatacttttgctatagcctataaggatgccacaaaataaaatctttgtttctattactgtgttttttgttggatccccggtctgttttcaaaaggaaaaagattagaaatagtgtattttaatgtctccagtcagcgtctctccatctgtggctgtcactgtgtttctcttagactgctgctttcagtcatctgcctgctgattctccttctgctggtagatagcaaatgtgccatctgccatggggtgctgctgcaggtcacaccttcaagaaaagattactcttaagtgtataattatgtccagatggcagaaagctcttttgcagctaacacacttaaccagagtctggcatacgggttattacggccctgtacgtgggccataataaccaaaaattaaaccaaaagactaaaagggcattgttataaatcaggctgttagtagggactcgaaaaccatatagtacagtatagaatagtaagtataaggcgtccttatatgttttgatcacctactgttttgcaaggcactctgccaaatgttgagcttaaataggggtttcctattaatgtatttaggaaacacttgagaattgctgaagaaacttggtcagtgaaatcatatgtaccataggatatgcacgttatttatgttacatttgcaaaatgagtacttattttaagatacatatttcactaagttactaaaattttcataaatgaaaaggtcttcacttaactgttagaatcataatttgatatttgtaaagtacttgtaaaatccctaatacttctaagtgcttaaataaaaatagaataaaatacttatatgacttgtatgcaaggatttaatcatagtagtttgatatttaaaaatagagtaaatcagaaactttataagccaaaaattttttgtttgtttttgtagacatggagtcttgcccaggctggtctcacatttccgggctcaagtgaccctcctgccttggcctcccaaatgctgggattacaagtgtgagccaccgcacctggccccagatattttttaaaatgttaaacataggcctgaacatctggaaatagcacataatttattaatagaatttagattctatgtcacattgagtaatcaattaaggactgtttatgacagttaactttctgaagattttctagttaaatcctttctcaaacgaccctatgtaaaagtacacagtaaaaacactatgtaatattttgttggcattccaaatggacccttttatagaaatttaaaacttcatgtatttgctttttcctaggagaatctcatcttttattggttggggatcctggcacagggaaatctcagttcctcaaatatgcagcaaagattacaccaagatctgtgctgaccacaggaattggatctactagtgcaggtattgtatgtgacaatttcaagtaatttaacattacttcagaagttaacacaatggttttttctaatgaaaaactacctataataggataaatttcaagctaatttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactgaaatttcttaggtagggaatgtttattaatatttggaaaatatacttccatcattgcaatgtggagcttcattcataagttgtaatgattctttagcaagtacacttaaaagcctttgcaggtagaatgtcaagatttgattataaataaagtgacccagggaatttagaaaaaaattattttaaaaaatatgtttgatgctattttgtatttttacagttttgattgggtaatgtttctgttcttctgaaaacagacccttggcttcacacattttaaaaatgtttgctacttgttaagggagtcagattaacttccattgggctaatgaatgctcaaatttctaatgagaaactaacactttaaaatttatcatacaacagaaaatggccaattaatggtcctgtataagtggaaaactgttaaggaggtctcaggttttgaaatataactcaacagtatattaaccattgacaagaatggatttttggaattgagaagggtagacaaacttcaggatactaggcaagaatatataaagaatatttcccatgcgttttaaatccgtatgacccagtgttctagagttctgtataaaatgataccaacaacaaataaagatgcttcccaagtaattatgtggaatgtttcctaagtaattatgtagagtgtcaagaaatgagtccaagccatctaagtggatgactggtaatttcagagtatttgggcagtttgaaagtgaattgctgctgattcactggattagtgaattagtataaaagtatattagcacatttcctcctttttaatgcaaagatcataatccaaatatgagagaacaagtatagggaatataaattttacggttatagaatagttattgctacttctggtctacccaaagggccacgctagcctttcttcagattgtgtactgcaacccattagagtcataaaagtcaattcagtgggtcaaaaccagcactttcaaagtaaaatacaattaaaaaaaaaccaaaatactgcatagtaaaggtgcactaaggatgtgttttcatgaaattttttaacataaatataaacttgttatggagtctttttttttttttttttttgagatagagtctagtgctgtcgcccaggctggagtgcagtgatgcaatctcagctcactgcaacctctgcttcctgggttcaagtgattctcctgcctcagcctcctgagtaactgggattacagatgtgcaccaccgcacctggctaatttttgtatttttagtagagacagggtttcaccatgttggccaggctggtcttgaactcctgacctcaaatgatccacccgcctcagcctccccaagtgctgggattacaggcgtgagccactgcgcccggccctaagttttttataccatggattatggtaaaaagttttgataactgctgccatagacattcttgggaaagctagaaaccccaaatcctaaaattagagggtatagttatatgggagcctaaagttgtataaggttatgaatgggcaaataaatgcatgcatacttcttcagacctctggaatgttttctcagcccaaataatacccttaatgcctccatcttagtggcataagtcattggttcatgtttatattcttaggacacagctatttactatgagcaaaagggtggaaaatagttcttcagatacagtattggcaaatgacgctagaccgggtggaaaaaaaacttatgtgctacagtttcttacgtttctaatgtttgaagtctaaatctattttcagtcattaaaaaaattcttagagtgataaaatttaagataacaaaaggtaatggttcgcatgtcccaagcttaagtgaaaattggttgtccatttacaacttgatacaaaaacctaaccctttgatgtcactacaaatagattgttataattagtcagaataaaaactcagcagtaaatggctttatttggtgatttggctgtatatgctttatttctaataagcacatatgttgttcctattatattaaccactgagctctttgttggaaagtaatgcttttattttcattttaatattttaacatttttcttttaattgcaattagacaaatgagattttctttatatagttttaacagtcagaagtattttacttttaaaatctatgaactagttaatggacaatattttaataatctggtatattaaattcaaagtttaacatctggcaaaactttgcttcacaaattcacttttttagaatgataggaaatatatacaactcagaatccatgtttagacaaatgcccttttcctttcctcaacataaaagctttaaaaagtgcagtataaaagttttagatatgaaggcactgcataacctgcatcatatggctgtcttgcttagctgcaagaataatgaaaatattctacctcaattttatggagcataagaaaattttttgaggaaggacttaactctcaaagaaaaagaaaccttttaccccatttagttaatgaattcctttccaagattgcttttcaaagatttgttggaaaagctatctagagtatgtcaaccacaaatatgcctgatctcattctgcatgagtgtcagaggaaatggggaagagtactacaggtgtgaaaatatatatatttccaaaatagtaacgtatctattataataaagctaaatatacctttctaaatccatggtttttatataaatactgccaataacatgatctattaaaagaatttttaaaggtcatggtatttttagaaatcaaatgaaccaatttgagccattgtaatcccctattcttaaacacagggagtttgtattttctcccgatattgtatttggtcttgaattcactggacaataatgatgtatgattcaagaaatgctctgatattctaaactctgttataagaacaaaaaccatagccaggggaccttattaacaattagccatatttgttcttctcttaccaaacaaaccaaatgctgtccaacatctcatgaactataatagtagccataagaggcttcacggtggcttggaaaattggatcctaaagttcttggtagcatatagttgatttcaaatcctctttttaaggacatgccaaaaaagaatggaaatctgccccttaaattaaaatgataccatatgtcttcacaggaagaaacattttagttgaagtaaactttgttctttcaaaggccagtaaaatagtggtccaaagactgtctgggaggccaagacatctttacaacctggtctaatgattcctgtttctttataagtgctttcattacatataaaggagaagaaaataatatatatgctttaatcagattagtttcagaacaaataaaataacacattagagaaaaaaattacttaaaaatagttgtatttatattccacaatttgttcaaatactggttttcttataaactttctacaggatgtttttaaacaaattcttcacattgtgttttgactatgtacttacggaatttcagggaaatagttctgtgtatttttaatagcttaatttgtactaaagggatggtaggtggtcacatgcagtccatgtgggattctaacatgacatttagtgagttttctgatgtggaccatccctttgatgctgaaggtaatgcatctgttgaaagaagtgactgtagatttggattactgctctctgcatcttccagtttttctgtgttatcttcccaattaatgtggaatcttgtgaccctgggattagatgccaaaatattcctttgaagctagaggaaaaaggaaacatacaaatggtaaacactaagaaagttaaatcaccatatacaaatagaagcttaataaaatggttcatgttagtactcctaaagggctaagttcatatacaaaggtataattcaagttaagtaccttaaatataactaataagatgtaacgactagggctgtagcaaagaagttattttagattaacagaaacaagatacggagaatctgaggggattcatctggctttttaactatttaactcctatacttctgttttctaaaagaaagaatctcctcatttttgaaaatgaatgcttcagaagatgctttatttaacaagctactatgttgtttagattggtatgttttcaaaggaaaatgaaaaattgtcaaatacaacttattattaatggtttcctacaccttttaaagatggctcattcttagaaacagtcctgtttcttttgtgctatataaggtgcttcagggataacaaattggatcaatggaaggtacaacaagggtgaaaaatagtccggccttattatcagaaagaacatgagaacattctattctattgtcatgtaatttttcttgcatggttcaacttcatttactctgcactctcacaaaatcaccagttaccaaactgttatagttcccagtgaaaaatcagaaaatactaagtatctttaagaatgctgaatcctagatttcagcttctcactcagaatttaagctgttttcagtaccagaaatatttaagactgttagtttaacttctaagaatagcagataaagcgtataggtgttttgagataaccgtattcataggaaaaacaaacataaaactttcataattttgggaagagttacacacaaaaatatcatcattgaataattagtacaacaaaaatgcatttgtttgtcctaaaggttgaaatgaacagaatcatgatgggaataatcaatatgggaaatgctataaagaaagccataaacaaaggcctgtcttacaagaagtactttctctgggcgtggtggctcacacctgtaatcccagcactttgggaggtcaaggtaggcagatcacttgaggtcaggagttggagactaccctggccaacatggtgaaactccacctctactaaaaatacaaaaattatctgggcgtgttggtatacacctgtagtcccagctacttgggaggctgagacaggagaatcgcttgaacctaggaggcagaggttgcagtgagccgagatcatgccactgcgctccagcctgagcaacagagcaggaaaccatctcagaaaaaaaagaggtactttcatttttctaaaccagaaatgctcaaggtgtctgcctacattaattactaatgactcatctgaaggtagggtttgaagtcatccatggtaatggaacaataattagtttgcccagttggcataaggacctcatatttattttatctcaaagccattttaatagtatactatgaaattgcaatagcaactgctttaaaaattgcatagtaaaagtagttaaaaaggaatagtaagaacattaccttagaaaagtctggttttactggtggattttcccttaattctgtctcagtatattcattatttacataatagccaactctaataaattcttgtcctcgataggtacaagtaattagcacaacagttacgcctactgcatctgcatctggaatgagtcctggattaggtgcatcagcctagaataaattaaaaagaaaagaaacacacacacacaaaaggctgttagtggcaggcaagactggagtttcagttacctagaaccatcagttgaggatgcaacaagaaaaacttggaaatcatactgggaaggaaaatgctcatttctgactgacttataataagctggaaaagacagttcatgttttgccacaatatatgtaaggacccttgatacttgaaagcatgactacacttgtaaaaggaagaaattctggctacactgcatggtggttcatgaaaggattatacactattcattataaaacctttatagtcagcaattgattttaaccttttcagtcataattttcagacctaaattagtaagtattaaatgatctcctcatagactgttggccacaaatgtttattataccagtttccctcttcaacccaggatacttatattctcatacccactcaaccacccccacaggtattctaatagtaaattagtataaaactgaaaatgaggttgggtgtggttgcttacacttgtaatcccagcactttgggaggccaaggtgggtggatcatgaggtcaagagattgagaccatcctggccaacatgatgaaaccccatctctattaaaaacacaaaaattagctgggcatggtggcgggtgcctgtagtcccagctacttgggaggctgaggcaggagaatcacttgaaccgaggaggtggaagttgcagtgagctgagatcgcactactgcactccagcctggcgacagagtgagactccgtctcaaacaaaacaaaacaaaactgaaaatgagatggaaatagctacatagcagattttcaaaaaatattaataatcctctattatgaatagttactttgctagactctacaatatagtatgctctttaaaccacacataatgtggaaaccagtgaaggtaaggattgctttaggcagatgtcaaagaccttgttttaaatcaagctattgtaaggtgaaccttgaggaatgcagaaagtaaactgagttagactagactaagagcatgagcgaagggcagggccccatccgtggtagggtgcaggtagtaatgagacgaccggatggaaggagccagactggggaacacaggcagtgatggctgaggcatctgaggcagccattctgggtggtaaatggatcaagtcccagcaaattagcttacctgttgccagggcaccaaggaatattcctgggcctagatgagcactttagccaatgccttagcttgtgaaaattgaagactgttgtttactgtatgcctaacacaggtagatgatacaaaaaggcataaaatcgctacctagtgtcctaggctaaaaacctcagtcagcttcactcccttatctcctacatctagtcagtctcaacatttttttcatttctggaggctgaattcatgtcatctcctatctggaatattgcttagaattttctaactgatctccccagctctagcctatcatttgcactgctaccagcattaacacagatatgttctttctctttggttttaaaacctcagattattaaaaccctcagaagagtattcccttttctaagggataaaatctcagttctttaacttcattgacaaggcccttctcagtttgtctccagccaatatctccattcatacctcctttaactccaccattgttctagagatatgaatcacacaggttctttaaaacgtggtgataatcttttcacgctctgagcacggtggctcacgcctgtaatcctagcactttgggaggctaaggtgggtggatcacttgagcccaggaatttgagattatcctgggccacatggcgaaaccccatctctacaaaaacaaatttaaaaaagaaatacttcaccccctgtgcttctaacatactgttcccttggcctgaaaggtccttcgctcacatcctgaaaaattcatcttttaatcttttttggagcttacatcgagtgtattctcagtgacgccctttctaactcagaaggtagaatcaatagattccttttttatgtgctgatatttcttgtcacaaattatctaagaacgtatgccctgtgatctaaacatgtttatttttcagtcttctcttctagatgctatgctttatccagggcaggagtcccatccagttcatctttataatctcgtgtggctcagctctgagcacttagtattttggaattcatttgtaaatcagttcctgccctgaaggggtttatgatctcttggcaagacaccaggataggggacagccagccttgtcctggagaatatgctgtttgtcttagagattctacacacccctgcacagaggggttagattactttcagtgtacccaaacggattctaatatacctgaagtgggtggagatgggaaatatataatagttcagtactgctatgagaactcttccccttcccttcagtaaattggttcccttcagtaaattggttctaggcatgtttctgttttaaaatctgttgtaaatataaaacatcttttaaaaagcattttacaatttgaaaaagattcagtttgagcaaatttaagtagagaagcttacaggcctttcaaataatttaggatgcagaagtaatgagcagagatctttgttttgactctagctggcaatactaggcagatgtctggacatcttcctgctagcctttgactcactcagaagaaagacatgtttaactatttagagaggcaaaatcatggcagaccaagagattactatagtagttttaaaatacaaaacaaaagctgtaatttagtctctttctgttgataatggtgaattctgtaaaacctttaggctgaatatacattgtacctcctctgttctttttggcaacatgtacactgacaccaaggtaaaactacgtgaagatcaccagcaggaaatacttttgaatacattttttttgctacagcactttcagccaaaagcttaggagtatgcttaataacaaacacaaaagattttcaagggtttgtttcaataacaaggcatttatttgtaagttcttatagtagccaaaaaaaaaaaaaaaaaagtattatcagtacctgtcaacccaggtttcttttactgtatcatgaattatcagtaaagtatgggttccttaggcctgtgggtcagagcaagtcctgcttttttatataacaatttcaagaagttaagagaataaaaatgtagttctaattttaggaatagggcactctttatgagtgactgattatactgttttattccccataacattttaatgagatagaatattatccacattttatagaagactggaatgactaagggaggaggttagagaggtaaagccacacatggctaatacagaggtgtcgggatttgacctatatctataactgcagtgcttccttctacagaacagggcattctgttacccatgtcttttacatggttatgcactcacacaactttgattaacagcacttttaattcatatatttgattagtatatttgagcttttcttagctatttctttagatacagtaaattatttgttgctttttaatcaaaagtactaaggctaggaaaccaagattctaaattctgtatttaggacaggggagggaaaggtagcagctctagagatggcatgtgtctaagtgattctttgccagtttctgatgggattatttgaccaatggtattcatttaaattggtcccatctgtgaagtgagaaaacagaggtcaggcataggaagagttagattttctttctggattaagtcttttcagtgagttccacttaactgatgggacattgctgggttgaaatacttgtaacagaaattaatagtagttttaaaaaacctatggctagttactctttggtctattacaaacatctcccttataaataagcatgcataattgaggaataactgaatggttccatatagcaatttaacatggattaaaagaaataacacttttgaatatagaagacaatgtctgaagccttggtatagatccaaatactctcagtggtatctaagaacaaaatttttattactagaaattctcttcacaaatacctagtggggtagtaaatttgcaaaagtagtcctcttataagataatgtagattataagatgctttagtaaactctggaatgtcattccaatgacccaagaccacacatctctatccactaaacgtatctgttaacctagctcaactactgattatgctgaaataaagttgtttttgttacatcaccatcagttccagtggctgaaaccataaactgaagatgcatattactaacaatgccagttagttttagatattttgaatccatgttttgggttgctagacagccaccttggaagtctgatactgaggtgctattcacaggaagagccccaaattcaccaccctgtgtgccatgatacagtataaaatttactgtaggttgttcatctctctaaagtaaacgtcacattaacatctctcagcatataaaaccaggaagtaagagttcctctgtgacacagagactgcctaaaacatgatggaaacagatttaaagtgaatgcagcagaagcagttctttaacccaaaaggaaagggataagggttataagataatagataatatagtctacttcgaaacatatttggcatacacatttaccaagattaatcttacctgaaatacaaacatatgccttcctgcgggaacaggacccactaaaacagagtctaaaacttgatcgtattcttcactttctgcagagcccacatagataattttccattccaagtctagggttaaaaaaccaaagcattatttcatattcagtaattacattaccagatgacatcaaagacccttttaatgtccacttagccacttactggctttaaaattggcttctcatagcaatccagaaaggcagtgaaatgctccttataaagttcctaccagagttcacactttgatcagagtttctcaaaatactcttttgtgaaacactagttcctggacagtgcctcacaaacaagataacatagccaaacacttgggaaatgctgtaaaccttgtcttgaggattcataaagcatgctggcacagtaagttttctgagatatccttcagtaaagaacaccagtaacattaatccagcacttcccaaatttatttggctatggaatccccctttttttgtatatcatcttttaaggcccttctcaacacactttggaagggcagccctatactacgctgcagagatccaaataatcacagagctccaaagtagaaaaattattagtaaaacctccctcatggctcagaagtaagtggcttcagctcatcaactgtcaacgaacaatggtagggtttttcccttacggcacccccctgtgtcatacattctttaaattgggcagaggaaaccaagatctttacaccacgtgatacaatagagtatacacagtggagataggcaggaggaaaagacattcaggtgcaattcaaggcgttatatgtaattcaatatagcggattttactgagcatgttttacaatgtgttctgtgaagtgaacccagagatgagtagaactctttggaggagtctcctgtttagctgaggaagaagataactttgtaatacaaaccatctctgagagacctcttcatcttctttgggtattttgcactgtgtggcctgcctcttgcattcaacacactgttacacaagcactcccaaagggtgagtttctgggtcactcatgacaatctagttagtgccaccatgtgtggccatttttgtgtaactgtagatatttttgttccctaaattgataatagaaatagtaacgtactgcttatttatattgtattgtaaactacaatcaactgaaagctccttttttattttctcttattaagtcagcaatcattttctgaggacctattatgtcatggctctgtcctagaactaaaccatttctatttccagcttccagcacacttccagatgcagggtgctgcatctgacatctcctgagatcatctgttgatggagatagagaggaagtaggcaatataagtatctcgccagagggaacagcaaatacaaaggcccaggggtagggcacacttggcaagaaaaagcaaggaggctagggctggagcagaatgaaaggaaggaggaaagcaccaaaccctatgattgaggatgaggggaacagccagatcatgcggttttgaaggccatcataaggactctggctttcacactgcgtggcatgggaagccatcgaagggttttgagcagagcagtaacaggagccaactttcattttaaaaggaatgctttgattgctgtgttcaatatagagtgtaagaggacaagggaagaaacaatatttcaataattgaggcaagaaattatggtggcatggacctcgtgtggccatggggctgtgcaacagttatattctggataaaatcctgaagatgaaagcagcaggagccacttttgcagggaggtgatgtggggtaggggagcaatcaggagttcattttagacatatttgagatgtctgcttctaagcagagatactgaataggcaggataaaaatttggaacctgtcaatgatatgtaaagccataaaaatacatgggcttgctctagggagtgagatttgagccctccaaagataagaggacaaattaagttacaaaacaagtggcaaatgaggtaggtgacccaaaagccaagtgaagaaactgttttaagaaagtgatgtgaaaggtactaaactagccaagtgaggataagactaagaattatcacatagagtggctgggcgcagtggctcacgcctgtaatcccagcattgtgggaggctaaggtggctggatggcttgaggtcaggagttcgagaccagcctggcaaacatggtgaaaccccatctctactaaaagtacaaaaattaggggtggcacatgcctgtggtcccagctactcgggaggctgaggcacaagaatcgcctgaaccctggaggcggaggttgcagtgagccgagatcgcgccactgcactccagcctgggcaatggaacgagattgtctccaaaaaaaaaaaaaaaaaattattacataaaggttttcatgaattttaatttcatatataattgtatcactacatataatgcccttgatcctaagtggtataaattcgcatttgtggactggcataggaacatagccataatttataaacctattttagaaaatacctactatatactgggcattagttctacttcatacctattgtttaaacctcaacagcttcatcatgtagatcaaattatccccattatgcaaataacttgagactctgagaggttaagtaatctacacaaattcataatttgtacatcaaagaatcagaatccaagctatgcctctgtaactacaaaccccgggcttcttctgaaaacctaactgggaagataaattctttctagctctgaaattagcagtggaataagggaatttatttgcaggggaagtgagagcagaggagatggagagagaatctagccttaacaagaacaggctgcaactcagggaacacttgtacattgatttttatgtttatgggatgcttgctacagttgctgagttttacatgctcaatacccttttatacattggcatcagtttttttgttgtttttttttttaacccagctttcatttaattcctctgccccctgtatttgagggaggaagggtaaggtcagatgttttacataagttctcaggtgaagaaatttgttcatttattttaaagttaacttttatttaatcacagtaatcatgattaaatgatttacccagcctgaaagtatttacatttgtggtgaaagagtgagtgaatgagggaagtcatcaagagaatttttagctaattacactacttgggaagacctgtggtctagtggaaagtatgtaggctttggaattagaacaagctgaagttggaaagtatgaagcaccatgctcaattctggtatattataagtattcaattgacagtagctgtaattaagatatatatatatataaatttaagaatggcaggatggtcaatcaaaacttgtacagtcttggtgaccatcaagcacatccagccagggtctcaggctgtcttaacccttgatataagccctatattagaaagaaccaaattatcttaagaccaaatattcctcaaggctttttctgaagcaaagctacagggcagctcttaaaggaaagtgaacgtttggggctactgatgaaagtatgaaaaacggtggccaaactctgctttgagacttgaggcaaaataacttattaagaaaattcttttcaaaatattctatagtttgggctgggtgcagtgggctcactataatcacaacactatgggaggcaggggtgggaggactgcttgagcccaggggttcgagaccagcttgggcaacatggcaaaactccgtctctacaaaaaattaaaaaattagcccaatgtggtggcacatcgactatggtcccagctattcaggaggctaaggtgggaggattgcttaagcccaggttgaggctgcagggagcagctgtgtttgcaccactgtactccatccagcctgagtgccagagcaacactgtctcatttaaaaaaaaaaaaattctatagtttaattttaagaacagaatttttaaaagaactgtaatataaaagtatggaacctattagaagcctttgctaagtaaaaatttccttaatccacatagcctctaggtggagtatacaggcatggcacctttttgaaagattcctttgcagcttcagtatgactcagcttaaaatattttttaaaatactaaataaatgctcagtaatggtgcctaggaagtgaaatataccattggaaataagtatgtttttgacaccagtactgtaaatccctgatgtgattcagctgggttctgaatggatcccagttaaaaatggaacgttttggctttatgaatggctggtttcatctatgcaatgtaaaagccctgtaacgacatcctgagtcatctatcttctttgttcagagctgactcctaaaatggaaggcaacacttgagaaatacctgtaatttgaagaacttctggtggtatatctgaaaaacagtgtggtataagttggaatggaccgatcaatggtttttcttttgtctatttttatatgcagttggcaataaaaaaaaaattactgttgggtgtgaaaaatgggcctggtagctgcaatgcttatattaatagtagtatcataggagagtaatcaaatgacttcagagtaataagaaaaataccccttagtgttatcaatggcctatttgaaattattttaataaatgaatcatctttcaaaatttgccctatatatgtatgtgcatttatgctctatataggtttaaaaaaaaaaaaaaaacgggggcacatgttaaagtaataattgtgattaccgaaaggagatagggcaaggcactgagtacagagaactgttaactttatatatgcctgtacaactttctaaaagtttattacaatgaatatatattgttttataattaaaattaaccttacatatgatatatacattttagagattaaaaactagtttttaaaatgaaaagttttacatgccacgattacctaaatcatcttcaatgcattttttacatatacttctagttcaaagtatgtccctcatcgatgaagttaaactatttccccttcaaaactggcaaatgaagcactgaattactttagtaaaagataattaaagcaaagataattgtcgttttagctttctaaatatttattactaaagatattaaaaatacgtatttttaagaccttaaaatatatgtagaaaaaataccaagaattcttggactgacatgaggagttgaccttaatttcctagcctacgtttgtgttttatgtttagggtgtgttctgtatttggatgtggagttattttagatttcaacacggtcttgaagaaagtcttccttcagactatttataaggcagagattaagtcctggaaattatttaagtatcttatttctgcttttaggttaaatgtaacttcctacctcagctctatttctcttcctgaaattagcttttcgtcattaggggaaaggagtccacgttggttggggagcctgcgcgccagcatcccggcgcatcccgggcgccggccgaggaggaccggccgaacaggacccacggcccccggggagcgccggcgcccagcccgcggcgcggaggggccgagcctgcgcccgcctcccccgctggttggtcgaggaagccagaaatcagcgcgaggacagcctcgctctcctccccgaagcggccaggcatggccagcccggagagtgcggcgactccaccgtgagctctcgagagtgcctgcctgcctttcgccgggggcaggcgggcggcggggcaagaggaggcgccgtgcgccggggtcgctggcccaattctcgactcggggtaagatggctccgctccgaactcgccggcgcgaccacacgcacagcctctcccttcccagcctccgtgctcgggcccggagggtcgcggaggctgttggcggcgcggagccagcccggcgcgacctcaggcggcgcagcgggagcgagtgcgggtctccgagctgcccgcccgcagacaaagctgacaacatggctacctccgctcctccgctcaaacaagttcctcgcaagttgagcccggcaggcgcctgggctgcggcggaaagccgcgcgcgcctcggcggccgtcgtccatcaacttcaagtttccctccgcagagcagcccgcggccgccaggcgccgaacacagccgcccagcgcgaggcccggcccgggaaactttcaacgtctgcagcccgcaactgacagcccgggcgcacgggcgccgcactcaccttcagacaggtcctcgatgcactcgaaggtgatctcgaactggaacgggttgtagaaaggagaagggttatccagcaccactacattgttcacctgaacctttgccatattttgaaaaaaacacaaacaatgggaactggggctggttgcggcacaataaagtccagcgcgcggccgctcgggagagcgcagacccccgctccagcgccggccagacgtcgtgcagcggcgacttgagaaacttttttcctctttttatttacacgggagcactccacagtgttttgcagctttcctatttcactaaactacagcccattctgctctgataagtagcagcgttgccctcgattggctgcacccgagttctgaccctcctcctccagcgagggcctcggcagccagcaagatgggctcccgctcccggaatggactcggaaactttaactgcggctccacctgctggtgtggattaggacaaaggcggagaacaaagtgagtggaataagggctgggaggcccgcgcggaggccgccggcggcggcgcggagaggggcggagggggcgtggccgcggcggggaggcgtggctgcggcgggagggcgcgatccggccgacgcccgcccctccagttggcttcgtgtgggtgttttggcgtttttttgtttttttttttgtttttttggttttttgatttaacgctctttttacatcagtgcaacagctttgccggccttgctgaatttagcagatgagagtcggtgtttacactgggttaggttcagctttctgcgtatcgggtagtatttggagtagagagaaagattggctgcaggggaaataaattgcatgttatagaccgatgtcagctcgaaaggagcaaagccattttggaaatctagctcttggccagtatctacgtttaggcacgacagcgccgttaagcaacacaaaatgaagggcgaggaatgattttctacacactgtgcttggaaaatttaaataggtaacctttgggcttgcacctgggcgtcttcttcggagtccagatctgggaagtcctagaataaaaaaaaatcacaagaggtgtgatcagttatacttcaggttactgccatttggagagcatagcaggaacataaaaggagaaaatggaagtgttaggagaccaacagggcaacaaacgtaatagagatgggaaaaagaacacaaagacatagcaagacatttgatcttcaaaaaaatttctgacctaaaccgttagtaaagcaaattctgaggagcccttgcttgcctgtaaccagttgaggtctgaactgaggaaatgttgattcgtttatgctgcttggctaccattgcggggaaagagaaagctttaacatatttgtgagcctaaaccgtttctatttagtaagtggtataaaggtttgttttattatctgctagccataaaccatcatttttttccttaaatgttgtgaatgaaaccaccaaacttggccaaattcagagagaaaattaattcttaagtatgtgttctggaagagttttctcttagtatagtgcccagaattttgatttgtcattctttggtcattgttcatacttaagtaggtggcttttgatgaaacgttttcatctgatggtcttttgaaagttaatgtgagacagctaatgtcaacccctcgtacatttaggaaaaccggttagagtggggaagagttccctttttttgtcagtggattgaacagttagatataggacctaccaaaaaacacttcttcaagccagttgtttgtgacattagagtattaagagtcaaaccatggtgatagacacagatttttgtggctgataaacaacatactcttcattcttattagtgctggtcctaacactagcagataaagtggaaattgctgtatgctgtaagacactctgtatatgtaagataaaatgaccatttgaagattaaaactcctgtgagactggtgtatgcagttgtctgattattacaggtactcttaagaggagagtctagtcagtctcatgaaaacgacattttatgcttgttaaaatcacgtgcattttgcagtctgaccgtaagtgttacaatgagactagttgtaaaactcacttttggtggatgtgcagcatgaaggactgagaagatctacctgaatgccactaatttggcttattttctttaaaattttttgtttaacacatcatatgcaacagtatttaagaagaaaaaactccccaacatttcactggaagctgcaagaattagctccaggcttctcctgtcttaactcttgtattattgcttgtcagaaatactaaagggtcgttgagcactttgttcaatagtttcctcaccattgatactaccttactccaggagagaccgaaaggattcctcagatatgtcctggcatatttctaatttaactggtatgctgtaggaaaaaaagaattgtgaaagcctctctctggtttcagaggcaatcagtaggacttgttgctgaacaactttggtgactcccaaacatctaattgtacaacagatgggtcactgtgaatgtctttattaagtacccaagggggtcccacataatgtttggagggctgcatggaatgtaatcccccaatcacttctcactatgggttacttgggggaaggatggctgagagagattttatcggctctaagatgaacagaacaaagcctaaactagtgcttagggcagaaatacatgaaactagttagttgttgttttagactgaattatgtctcccccaaattcgtatgttgaagcactaatccctagtacctcagaatgtgactgtatttggagattaagttaaatgaggtgattggggtgggccctaatctaatctagctggcgtcctcacaaggggaaatttagatttacagagaagcacaagggtcacacgcacacagaggaaacacagcaaaaaggtggccatttgcaagccaagcaaagaggctttagaataaaccaaacctgccaacaccttgatcttggatttctagcttccagaactgtgagaaagtaaatttctattgtttaagccacccagtgagtgatattttgttatggcagctctaacaacctaatatagctataagatatttttcccctcagaattaagcttatttgagcatctaatcttactgaatccaaatattggtcagttcccaagcacttcctgtgggtgaaatgatgtggtcctttagccatgccagtaagggtgtggcgtatgtggagtggtgtgctgttgccattcttcagaggaagtatataccactgggcatatagcttgaattctgaagacacaagatgcagcttacttgcatggattcaagactcctctacagagaagtgaaacttgaagtcaaattgaggtcatacacaaaacaagatgaaagagcgaattcaaatatactaaaattgaattaaatcaaaatgtgccaaattaaaatacattagaactaggaattaaattgagtgtcagcccgtgtctactgcaaaagttatcataggaatggaagtactaacctctagcttttgttcaaatctagatttccacctcgggtaatcactgtgttgaattgtcttctcatttgtattattaccaacttaaaaaaattcctcatgtaaggcttgttttaatatggtctttagttagtttaagaggctcctttttatttattagaaataggatgtcaaaatttaatgatagttttaaataaaattttctgtataaatatagactagagatttgatggagttcatagacatttctaaatggagtaaattgtacaataatgatttcaataataattcattacatacatacagagagcatttgttatgtgaaatttttatgctaggctctgtgagaaatagtcaaagataagacatacaaagaccttatggttcagtaggaaaggtaactaatcaaataagtatgatgcgaaatagaaagtgttagatgcacctgtaaccagttatgttaaaataggcaaaagaaaaaatgttttcttgacaatttgtaaaaaactttaaaatacctgtttttgagcctcacaaacaggaatggcaggagggtaagatatcatcccatataacaaatgaggatgctgctgctcagaaacccattcctctgatggctgtcctagtacctttgtactctctaccatgtcaagtaaattttaaagtgggctttgtatgtagaaaaaatagattggtatcattttctggaagaacccacaggctggcggacactccagtaatgacttgattaatgaactcttgaggaacaaagctccattaatgaggttggtccaggtgtatactgggagagagaaggagacccagccaaggcaaagctgggggaggctccccacggggtactacagatgtcaagcctcctgttgaaaaaggcatcccttggaaggtgtgggggatggagctacacatcctggaatgcatccttatactttttataaggtttccatgtctgttacatagcgtaccctctccccttctctgctccacgtcattaataaaagtttcactgttttgtgttcttttctacccatcattgtgttagaagtttgttgaaggtataagctatatctgatcccttatccatagctggactatactgtaaaacaccttttgcatagccataggttacatcagtcagctttctgaagcactgtaattacatttattgacagtttcttggtgtgtatatcattatgttgtttttgaccattttgaagggaaatgcctaataattattttctgtttcttatacctagttttttgtctgtgtcttcttagtcctcttatcaatcaaggtctttctaaactcgtttcctcttgaactcaagtctctacttgcagtccatcttccttcatgttttataatatattccatccttttctctctaaccctctactgctctcattcatcagaggttcactttttaataccaggaaaaaaaacagtaatcggtagagaggactcaaatctttaaaacatctctaggctagaccactgctcgtacaaagccattactaagcatagcagcttttctagttggttactatagagacaaatgacattagatggagtgacgcttggcagaagctaggcatgtaggctttgtgagattggaggcctcatatgcatggtcatttagaaagagtcaaaaaccagaaaggatagggaggggaaatgcttcacaaatgagctaataggtaattaattggtagaaatttggttggtagaatttgtgcctgataaggctttgaatccggcatgcaaagaatccacctctaagtaccccctggtatgattacacagtaatatttttcaggtaacagctttgttgagatagaattcacataacatgtaattcactcatttgaagcatctgagtcaatagtttttagaatattcagaggtgtgcaaccatcatcacaatcaattttagagtattttcatgatctcaaaaagaagctttgtagcctttagcacatccccctccccagcatatcccccaagcagtaggcaagcactgaattactttttgtctctatagttttgcctattctagacatttcatataaacggaatcttataatatgtagtcttttatgaccagcatctttgaagcataatgtttttgatgcttctttcatgttgtgttatatattgatgctttattcctttttattacccaataattttccattgtataggtataccacgttttatttatctgtcagttgatggacatctaggtggtttctactttttggctattacacaaaatgctgctattaacatatgtgtacaaatttttgcatgggatgggacaaatgttttcatttttctaggtttatgcttaggagtggaattgctgggtaagatattgtaactcctttttaggagctaccagactggttttctgtttgtttgtctgtttgttttgagacgagtctcactctgtcacccaggctggagtgcagtggcgtgatctcggctcactgcaagctctgcctcccaggttcacaccattctcctgccttagcctcccgagtagctgggactacaggcgcccgccaccacacccggctaatttttttgtatttttagtagagacggggttttacggtgttagccaggatggtctcgatctactgaccttgtgatccgcccacctctgcctcccaaagtgctgggattacaggcatgagccaccatgcccggccaccagactgttttttaaagcaggtgtaccattttacattcccaccagcattctaatttctccacattcccaccaacacttgctgttctgtctttttgattatagccatggtggtgtgtgacatagtatctcattgtggttttggtctatatttccctgatggctaaagatgttaagcatctttcatatgcttattggccctatgtatatcttctgtggagaactgtccattcagatccttaaccactcccttcaccccttttttaaaaaatacagacggagtctcactctgttgccctggctggacttgaactcctgggctcaagtgatcttcccacctcaacctcctgagtagatggaactacaggagcatgccaccatgccagctctttgcctattttgaaaattgggtcatctgtctttttatcattgagttgtaagagttccttatgtgttctacatacaggtcttttgtcaaacacatgatttgcaagaagtttctctagttgtttggattatcttttaattttcttggtggtgtcctttgcagtgtaaaagcttttaattttgatgatgcccatttaatctattttcgttatgttggattgtgcttttgatgtcatttctcaaaaaccattgcctaatccagcgtcatgaggatttacacctgagttttcttctaagagttttattcttttagcaccttacatttgggtctttgatcaagtttgaattaatttttgtatatggtgtgaaggggtccaaattcatacttttgcatgtgcttgtccagtttcccagcagcatctgttgaaaagactattttcctaatgaattggcttggaacctttctcagaatgaattgaccttaaatgtatgggtctatttctggacaatcaattctgttctgttgatctgtgtccttatactactgctacattgtcttgatgaccttaggtttgtgtagtatgttttgaaagcaggaagtgtgagtcctccaaccttgttcttttttttcaatattggctattttgcatcccttgaattttcatatgaattttaggatcactctatcaattctgcaaagaagccacctgggattgtgatagggattgcattgaatctatacatccctttggggagtactgccatcttcatgatgctgccttccaatcagtaaacatgagttcgcctttaatttctttgagtaatgttttgtagttttccttctttctttttttgagataggatcttgctctgttttttaggctggagcacagtggcacaatgatagctcactgcagccttgaacttctgggctcaggcgatcccccaacgtcagcctccagagtagctaggactacaggtgtgtgtgtgtgtgccaccacatccggctaattttttgaaatttttcatagagactagggtctcactgtgtcgcccaagctggtctcaaactcctggcctcaagccaccctcccacttcagcctcttgaagtgctgagattacagcgtgagccactacacctggcctgttgttttcatagtataagctttgtacattcttgattaaatttattcctacatattttattctttttgatgctattgtaatggaaatatttttctaaattcagattcttctttgccaagtgtgtagacatagaattgatttttttttttggtatctgtcagtctagctgaggtcatttattagttccaataaatttctagtggatttcttaggattttgtgtatacaagatcatgtcatctgtaaatagagatagttttatttctcccttttccttctggatgcctattgtttctttttctttctctctctctctctcttttttctttttggcccaatttctctgtctataacctgcagtacaatgttgaatagatatagtgacagcaaacatctctgtcttgttcctgatcttaatgggaaaattttcagtcctttatcactaaaaatgatactagctgtgaggtttttttagatgcttcttgtcaggttgaggaaattcctttttgttcttagtttgttgaatgtttttatcatgaaagggtattgaattttgtcaaatgcttttcctgcttctattgagatgatcatgtttttgttttttgttttttttttttggtcccttattctactaacgagaataccatattgattgatttttcaggtgttaaatgaaccttgcattcctggagtgaattccacttggtcatggtgtataatcctttctacataatgctagatttagtttgctagtattttgttgaggatttttgcatctgtattcgtaagtgatattgatctttagtattctggtgatgtctgtgtctgatttttggtctgtgggcaatactgcctatagaatgaattaggaagtgcttctccctcttttctctctatagaagagtttgtgaaaatttggtgtttgattctttaaattttcggtggaattcactaatgaagttatctgtgttgtttttctttatgggtggttttaaaaactattattactaatattgcctctgtgtttatagtctattcaggttgttttttctccttgagttagtttcagtagttggtatcattctagggatttgtcagtttcatctaagttacttaattggttgatgtaaaattgtttacactgttcccttacaatccttttgacttctgtaaagtcaataataatgcccatctttgattcctgactttactaatttgattctttcttttttgtttggtcaccctaactaaaggattgtcaacttttagtttcattaattttctctatttttattctctattccagtaatttctgctttaatatttattatttccttcctgtgcttgccaatagtttagtttactcttcttttttccagtgtcttaacgtagaagcttagattactgatttgagatcttcttttttattttatttttatttatttattcatttttgagatggagtctcactctgtctcccaggctggagtgctctgtctcccatgctggagtgcagcggcgcaatctcagctcactgtaagctccgcctcccgggttcaccccgttctcctgcctcagcctcctgagtagctgggactacaggcgcccaccaccacgcctggctaattttttgtatttttagtagagatggggtttcaccatgttagccaggatggtctcgatctcctgaccttgtaatccacccacctcgacctcctaaagtgctgggattacaggtgtgagccactgcgcccagctggctattgttttaatcttagggttctttgttgatctgcctagttttattatccttatgagttgatgattttatccttttaaaatgcccattttaattgctaataattttttaaatttaaaaatcttttgtctggtattagtataaatactccggctttctcattgatatttacatacgtatgtttttccatccttttactttcaacccatttctttctttgaatctaaaatacctcttgtagatagcatatagttggtttttcttttttgtatccatgctgtcaatatatgccttttgattggattattcagtccattcacatttaatgttactgatacggttgcattcctatctgccattttatattttgtcttctatatgtctcaagttgttttgtttttttttaaattccttttttactgctttcctttgtatcaaatgaatattttctagtatagcattttttatttctttaatgatttttctctatttttgttatgatttccttagtggttgttatagggcttacttaatgtatcagtgtttcagatgtagacttattttatttcactgagatacagaaatgttgtcaattctataccattttcccctttttatgctgtaattgttacacatatttcatctgtatatgttacaaacacaaaaatacattggtataattattgttttatgtaattttataccttttgaagaagctcagaaaagaaggaagagcaagagtttgttatattaactttcttaattactatttctggctctcttcatttgttcttgtagatttgagttaccatctggagtcatttccttaatccaatatagctttctttccacctgcattcttttgctgttactgccaaatatattgcatttctatatgttataggcccaacaatacaattatatacttttttatacaattgcttttaaaatcagtttagaaaagatatgtgtctctaaactgttttttctagttacataattacctttgccagtgctcattcttttttcaatttgagttatcacccagagagatttgcttttggcttaaagaacctcctttagtaattcttttaaggcatgtctgctagctactgatgctcccagtttttgtttatctgggaatgtctttatttttccataatttttgaaagatagttttgctggatatcagactccgggttcgatttttttttttctttcagcactttgaatatgtaatcccactgcctctggcctccactgtttctgattagaagtcagctcttaattttattgtggctcccttttaaatgaagagttgttctcttattgatttaaaattttctctttatcttcagttttcagcatttctgctatgatttatgggtgtggattttttaaaacatatatcctacttggattttgttgagcttcttgaatgtatagtccattgtttttcatcaaatttggagagttttcagtcatttttttctaactttttttctactccttttagttcccctccttctggtactcccaatatatatatattattctgattaaaggtgtacaacatttctttgacactctgctcattttttatcttgccctttacctctgttctttggattgcataatttcaactgatctctcttaaagtttgctgactttttcttctgcaatttcaggtttactcttgagctatctagtgaattttttgtttcagttattgtacatttcaaatccagaattcttacttggtttttaaaaatcctttttatctcttattgatattctctatttgttgagacattgtcatcatccctttttttttttttttttttgcatctttgagcacatgtaaaatggctactttgaaggctttgcccactacatttgaaatctggatcctctcacaggcagcttctgttgtctgctttttctccctgtgtgtgggccacattttcctgtttttttgcacatcttatacttctttgttaaaaaccggatattttaatttaatgtattataccagttctttatattaattctcctccaggcctcgttttttatccttttttttattgttgtttgcttgtttagtaacttggctaggttcatttcttgaagtctgtgtctcctcacagtgtgaagtcgctgatgttactcctcagaggcaacagcctttacgtgtgtgtacagtcactcttaggatgataattttaaccaacctttccttgactctctccttgatctctgttaagctatctgtgctgtttggtatcatactcggctggtaggctctagttgttgattgctctgttctttttggcaatgccctggggataagttgctcagcactctggttcaattaaatttggtcagggatactttttgaatccagtacttgaggtttgttctgaccccagaagtgctcttgttggctgtttccctggttctctatggtaaactagctggcctatggtttagcatacagctgtaatagagctaccagcctttttattacttgctaccaaaatctccattaggcttgaatttccctgcactgtgttccaaataaagtcagtttcttgtgggggaagattcagattttcctttccctgtttttgtggactctctctccccctggtcaaactctctgagctactgctccagccagggggcggaaatggtagcctctgcccttattggctttgtctttccaggtggaacctttaccttatgagtcagctggattgaaggcatttggggtgccgaggattctttgcctgtcacacctagggtagatcctctactctgtgcgttgggattgggtggaggaaggaagatcgtgaccttttggccacagtcaccaggaatttagcttctgtacctcacacgtggaggggataagaaatgctttctacccctcctggtacgatatcttatcccttgattaagagctcatagggagctcctcttcttgaccacattcacctgtagtgaagcctccatccagctaagcaagaagagaaggggagaggcaggaagcaggtcatgatttaagtgtcttagactctcactattcttatgaagttttagatttcaatgaataaatgtttcttcatttactgtatgcccttagattttccatagtctgtataaatggttggattttaaaaaataattttcaccagttatacttgcttcagtgaggaggatgtccatggagctcctcacactgccattgcagaagtgaaacctctgaagtgatgtttttaacgctgttttcactgttcagtttttctaagtgcagtcattattcctggtttgctagtaatttctggtgccatttttcctcccttggtgtttttaatgaagctttatttggtcactagttccatgtcctcatagagaaaatgtaatacttatacaataaattccgcacattgactcgctcactgaattttaccataggatacaaacaaactacaagtcaacaggaagatgagtgctgttttttggaagggtgtgtataaatatgtattgactggaggtactagttgggaaatggaaagtttcaaggaggaaggaaacgttcttatctagatgcggagggagtcaggattgaaaaaggtggggctcaggaaagttagggtgtataaattaaacattattataaaattatacgtaatccttggctgacatagtacttcagtgcattatgcttactttagtgcatgcagtagttcatccggggttttgctttgcatgatttcaatttcccatagtcaatcactgtctgaaaatagatgagttcattacagtaagatattttgagaaagaccacgttcacataacttttattgcagtatattgttataattgttctattattattttttgttaatctctgtgcctaatttataaattaccttatcttaggtttgtatgtgtaggaaaaacatagtgtgtatagggttcagtactagccacactttcaggcatgcactgggggtcttggaacgtatcccctgtggataaggagagactactatgctttgatattaacaataaatgtttgctgaattgttgaacacaggaatcctctacaagaagagagaatgaattggtactcatccctttgtcccctggctgccttctactaacttccctattccagtactaaaaacccaaagtttgaaaggaaagacatcttaaatataatcaccttttaatcattagaagtactatttatttccctcttcttgcctctcataagacagagacaaagagacaactttgttttccttctgtcttttgcattcaaggaattaacaaaagtgggaagaaatacttagctgtcttagtttttaattacctttgccacagatttcaggaaatggctgaaagtcctttctgtattgctaagagacagatttagaagggatttttagaacctttagtcctttaggcagttacctactcattgcataaatacctttttatactatcctgacaagtggacattctactttgacttactttgatgaaaagttcactattttgtaaggcagctcattcctcttcaaacacctcgagtttccaacagttccttgtaaacttctacatgttagtctcagttaatttcttttgaagctgctacaaatttatctaattcctcttccataggagagttttcagaggatataaaaatttcgattccctgtatttttttttttaattaggctaaacagacccaatgttacaaaccattctttaaatggtattatttgcatgtccttcattatttcattgccctttttattctttctttttcttttctttggtgttttttttttgttgttgtttgtttgtttgttttgtgcactctcactctgtcgcccaggctggagtgcagtgcatgagctcggctccacctcccaggttcaagtgattctccttgccttgcctcccaagtggctgggattacagggacccaccaccacgcctggttaatttttgtattattaatagagacagggtttcaccatgttggccaggctggtctcaaactcctgacctcaagtgatccacctacctcagcctcccaaagtgctgggattacaggcattagccactgcaccccgcctagtctttctattagttttttttttttttaatttgatgtcccaacatggacattaaaacactagatcaagaattggcatcctttttctgtaaaaggccacatactagtattttttattctgatggcagtataatgtctatcacaactacttacctctgccattataatatgaaagcagccatagacagtatgtaaacaaattagcatgactgtattccaataaaattatatttccaaaaacaggtagctaggccacattttgtgcatagatcctctagaagttgtctaacagatatctacacttgtgaatgctattcttgtgttaatgcatttttaagatcatattcagatattttgactgatattagtatagcttcctcaattctgttttggttattgtttgaacaaaatatctttctccatcctttcacttttaacctatttgtgcctttaagtctaaagtgtgtctcttgtagacagcacatagttggatcatgggttttttttttttttccccctccattctaacaacctttgccttttcatgaagtagttcatctgtttccatttaatgtaattactcacaaggcaggattcatgtatactatgctcctctttgttttctacatgtcttatgtcttctttgttcttacattcctccatttctgccttcttttgtattttttgtctgttttgttttgtttttgagacagggtcttcctctgttgcccaggctggaatgcagtggtatgatcttggctcactgcagcctccacctcttgggcttaaatgattctcctaactcaaccacccaagtagccaggactacaggtgtgtgccacctgcccagctaatttttgtatttttagtagagacggggttttgtcatgttgcccaggctggtcttgaacgtctgagctcaagcaatccacccacctcagcctcccaaagtgctgggattacaggtgtaagccactgtgcccagcctctttggcattaaatatattaaatatatattttctaatgtattattttaatacccttcttgtttcttatatatttaaagatattaatagttgccttgggggttattaccaactttttaatttaaagcagtttagttcagattaatgccaattcaattttcatagtgtgtaaaaatttgttacaatgtaattctattcccttttctttgtgctattattgtcatacaaattatatcttcatatgttataagccactcaacacattttataatttgtgcttatacaattttcttttaaatcagataaaagaaaaaaagttacaaagttacagttatgctgtctttcattttttacctatatagttatctttattggtgcattttatttcttcatgtagggttgaattaccatcttagtgttttttcatttcagcctgaaagactcctgtagtatttcttataggtctattagcattaatttgtttttgcttttttttaactttacattaattaaattgtagactatgtattttttgatcagtattatcttttaatattctctccatattgtgtttagctgtacaatactttatcttgtttttgtttttctgttttgaggcagggtctcgctctgtcacccaggctggagtgcagtagtgttatcatagctcactgcagcctggaactcctgggctcaagcagtcttcttgtcttagtctcccaaatggctaggattacagtcatgcaccaccatgccttgctaattttttaaatttttgtagagatgaactctcactctgttgcccaggcttgtcttgaactcctggcctcaagtgatccctcatctcagcctcctaaagtgttgagattacaggtgagagccaccacaccaggcctagtactttgttttttaattgttatgcattattccacggtctgaatataccacaatttattcatctgttctgttgatagccttttcagttgtttccaggtttaactattatgaagaattttatgatgagccctcttttacctatctccctcctggtgcagatggtcacaatctctgtatggaacagacttagcagtgaagtttctgagtacatgagtatgtataactgaaacttttgtagatattgccaaactcttttccaaaatagttgtatccgttattattcccattagtagcacatgagagttgactttgcctcacaaccttgccagtacttgcactgtcagatttttaaatacttaaccatacttgtgggtgtgtaatggcattacactgtagttttaatttgaattttccttattatttatgaggttgagcaccttttcatgtgtttattgactttctctttcatgaaatacctattttaagtccattctccatttttccattaggttgtctgtctttctcttagtggtcttggctaggttatgtagtactgagtaagagaccacttcaaaacttagcagcttattttgtttacagatctgcaatttgggcaggttttttctgttccatgtgcatcagctgtggcagctcaactgggggctggaggatccactttcaagatagctactcatatgcttggcacattggtgctgactgtaggttgggtgctcaccctgggctgtgggtccttggtcctcactttctgtccacacaggcctctctgtaggttgcttaggcttctttacaacatagtggctgggctctaaaatctagcattccaagaaaacaagtcagaaatgtctagcattttaacaatctagccttgaaaatgacatggcattgttttcaccatactgtatgggtcaaggcagtcacaaagctctgccctgattcaaggggaggggatatattgaacatattttcatgtgcttatttgccatgtgtatattttcttttatgaaaggactgttcaaacttttttgctcagtttttcagtgaggttttgtttacttcttactgagttttgcaaattctttatatattctgtgtacaagtcctttatcagataaaggatttgcaaatacgttctcccaatctgttgcttatctttcacattttcttaacattgtagaagaacaaacatttttaacttcagcgaggatcaacttataatttttctttgagtactgtgcctttgatgtcatatgtaagaaatctttgcccaactcagggtcacaacagtttttgcttattaattaataaaatttgttttttagagtagttttaggtttacaacaaagctgaacagaaactatagttcctatattctccctccctgccatgcatacaaccttctctagtgtcagctagtttcagagtggtacattcattacaaccgataaaccaacaatgacacatcattgctacccaaattctattatttacattaggattcactcagtgttgtacattccatgggctttggcaaatgtataatgacacatatccaccattatggtattgtacaaaatagttttactgcccccaaatcctctgtgatctgcctgttcatccctcatccctctttcccttcaacccctggcaaccactgatcttttaaatatctccatagctttactttttcgagaatgtaatatagttggaatcatacagtatgtagtattttcagattggcctcttttacttactaacatatgctattaaggttactccatgtcttttcatgctctgatagctcatttgtgtttaacaatgaatgatattttattgtctgatgtattacagtttatccatttacctactgaaggacaagatggttgcccccaagtttcggcaattatgaataaagcttctgtaaacacctgtgagcaggtttttatgtgcatataactttccagtgccttatgtaaacaccatggagcacagctgctgggttgtatggtaacgatctgtttgcttttgttagaaactgccaaattgtcttccaaagtggctgtccattttgcattcccagaagcaataaatgacaattcctgttgctccacatcctcaccatcacttggtgttgtcagttctttggattacagtcattctaagatgtgtaaagatgtcattattattattattattattattttaattattattattatttttttgagacagggtctcactctgttgcccaggctggagtgcagtggtatgaacatggctcactgcagccttgacctcctgggctcaagtgatgctcccacctcagtctcttgagtagctgggaccatagacacatgccaccatgcctggctagttttgggtattttgtagagacagggtctccctgtgtttctgggctactattgaaacacatattgctcaagcaatatgcctgctttggcttcccaaaatgctaggattacagatgtgagccactgcgcccagcttttgctggaagtttgattagcttgggttgaatctgtagaacaagttaagaagaactgacatcttgacaatatgaagtcttcctattcatgaaaatggaatatcttttcatttatgtagttcttctttgataacatcagacttttcctcttgtaaatcttgtaggtatttcattcatttatacccatttcattttgagggggactaatgtaaatggtaattttgtttgtttgtttgtttttgaaacggagtttcactcttgtcacccaggctggagtgcaatggcgcgatcttggctcactgcaacctctgcctcctgggttcaagcgattctcctgtctcagcctcccaagaagctgggattacaggtgcctgccaccatgcccagctggttttgtatttttaatagaaacggggtttcactatgttggccaggctggtctcgaactcctgacctcaggtgatccacccgcctcagcctcccagagtgctgggattacaggcgtgagccactgtgcccggccaatggtaataggtaatgtatttttaatttcaaatcaccttgttcattcttgatatataggaaagcaattgacttttacatattaacctgcaaccttgctataatcacttattagttccatgagtatttttttctcagtttgttcagacatcctacatagatgattatattatctgcgaacaaagagcattttattttttccttcccagtcggtatactttttgttccttttctcatcttattgtattagctaagacttggagtacaaagttgaaaagcagtgatgagaaaggacatctttaccttgttcctgattttggtgggaaagcttcaagtttcttaccattacctttgatgttagctgcagattttttgtagagagtctttataaagttgaggaagttgctcctctattcttagttttctgagagttttttgtgttgttgtttaatcatgagtggctgtcggattttgtcagatgctttttctgcatctattgatattgtgatttttctttgttaggccgttttatcaacggcctgatgattatattaattgattttttattttatttttttgagacagggtctcattctgttgtgcaggctggagtgcagtgactcagtcttggctcgctgcaacctctgccttccaggttcaagtgatcctcccacctcagcctcctgagtagctaggactacaggcatgcaccaccatgcccatctaatttttgtattttttgtagagatggggtttcaccatgttgcccaggctggtctttgaacttctgggctcaagcaatccgcccacctttgctcccaaaatgctgggattataggcatgagccaccacccccagccttaattgatttttttaacgtgattatacctaggataaatcacacttgttcatggtgtacaattctttttatgcattgtggactagatttactaatattttgttaaagatactggcatctatgttcatgaaagatatggactgcagttttcttgtaatgtctttatctggtgtggtattaaggtaatgttggcctcatacaatgagctaggaatcattccctctgcctctgtattatgaaagagattgtagagaattcatgtcatttcttccttaaatatttggtaaaatttaccagtgaacccatctggtcctggtgttttgtgttttggaaggttattaattactgattcaacatcattagtagatataagcctattcagattgcttctcctggttgaagttttggcagattgcattttttaagaattggtccatttcatccaggttatcaagtttatgggcagagttgtttgtttatatgttctttattatgctgtaatgttcgtgggatctgtagtgaggttctttcatttctaatatttgtaatttatgtctcttctatttttgtcttcattatcctgtccagaggccgatgaattttattgatcttttctaaaaaccagcttttggttttgttgattgtcattgctttctgtgtagacttcctttcttctcttctcttttctcttcttttcttttcttcctcttttccccttccctttccccttccctttccctttccccttccctttccctttccctcccctcccctcccctcctctcccctcccctcccttcttcccttcctgtctcactgtgttacctaggctggagttcagtggtgcagtcacagctcattgcagtctgcacctctcaggcccaagtggtcctctcacctcagcctcctgagtagctgacactacaggtgtgtgccaccatacctgactaatttttaaaataattttggtagagatggtgtctcactttgttgctcaggctggtctctaacttccgagctcaagagatcctctcacctcagctctgcaaaatgctgagattacaggcgtgaatcattccacttggcctctggttttcaatttcactgatttctcttctgattaaatttttttttctgcttactttgtatttcatttggccttcctttttttccctaagatgagaacttagattattgatttttgtatcttccttcttttctggtgaattcattcagtagcactaatgtcgctctaagtgcttttgctgtatcctacaacttttgataagttgtgtgtgtgtttttttttaggtttttaaaattatttaaaaacttttttttctgtagaggtagattgcatcttgatgtattgttcaggctggagtatagttgctatcctccaggcacaatcattgtgcactacagccttgaactcctggcctcaagtgatcctgctgactcagcctcctgagtagctgagattacaggtgtgtgccatcaagtcatgtttttatttgcatttagttgaaaatgtttttaaatttctcttgaaatttcttctttgaaccatgtgttatttagaactgttttgttcagtcttcagatattttgggattttccagctgtctttttgttactattttctttttttttttgagatggagtcttgctccatcgcccaggctggagtgcagtggcacaatctcggctcactgcaagctccgcctcccgggctcactccattctcctgcctcagcctcctgagtaaatgggactacaggcgcccaccaccacgcgtggctaattttttttgtacttttagtagatacagggtttcaccgtgttagccaggatggtcttagtctcctgacctcgtgatccacccgccttggcctcccaaagtgctgggattacaggcttgagccaccgcgcccggcctttattattttctagtttaatttccttgtgatgcaaacacagacattgtatgatttccatcctttaagatttgttaaggtatgctgtagtccagaatgtggtcttttgtttgtttgtttgttttgtttttgagacggagtctccttctgtcgccaggctggaattcggtggtgcgatctctgctgactgcaacctttgcctcccaggctcaaaccattctcctgcctcagcctcctgagtagctgggactacaggggcccaacaccacacctggctaattttttgtagagacggggtttcaccatgttagccagaatggtgtctatctcctgacctcgtgatctgcccgccttggcctcccagtgtgttgggattacaggcgtgagccaccgtgcctggccttctttatttttgatgctattgtaatactatgttgaacaggagtgacgagagtgggcacccttatcttgtttgtgatcttagaggaaaagccttcaacttttcaccattgtatgtaatgttggccctgggtttgtgatagatggcctttattgtgttgaggaacatccttctacccctaacttgttgagaatttttatcctgaaaggatgtttacttttgtcaaatgttttttgtacatctattgaaatgattttatggtttttgtccttcattttgttaatatggggaatcatatttactgattagcatatgtggaaccaaccttgtaacctgtggataaatactacctgattatggtgaatgattctttcagtgtattgttgaatatggtgagtgattcttttaatatattgttgaatatgttttgttattactttgttgagatttttgtatctctgttaatcagtgatattggcctgtaaattttttttgtagtgtctttttctggctttggtattagtgtgatattggcctcaaaagatgagttcggaattctctttctctctagtttttggaagagttgagtaggattggtattaattcttctttatatgtttggtaaaattcagccatgaagccttctggtcctgggcttttctttgatgagagacttttaattattgattcaacttctttactcattcatccatgcagattttcaataattttttggttcagtcttggtagattatatatttctagaaatttgcctaattcttctaggtggtcaaatttgttggcatgtaattgttcagagtagtctcttataatccttcatatttctgtattatcagttataatgtccttttcatttctgattttgagtcttctctctttttcctcgtgtagctaagagtttgtcaattttattttttaaaagtcaacccttagttttgtttatcttttctattgtttttctagtctctatttctgctctgatatttgttattctcttccttctgctaacattgagctcgggttattattctttttctagtcccttaagttgtgatgttagattatttgcaatatttcttcttttttgatgtagacatgtattgttataaacttccctcttagaactgttttggctgcattccataagttttgtcatgttgtgttttcattttgtctcaagataaaaaaaaaaacccattaatttcttctttgacccaatagttgttcagaagcatattgcttaatttccactgtgttaattttccatggtcctttctgttattgaagcaagtttcatatcattgtggttggaaaagatacttgatatgaattcagttgtctcaaattgaagacttgttttgtggtctaacatgtgatgcgtcttggagaatattttgtgtattcctgagaagaatgtgtattctactgctgttgagtggaatgttctgtatatgtctggtaagtccatttggtctaaagtatagttcaagtccagtgttttcatattgattttctgtctaaatgatctgtccagtgttgaaaatgggatgttgaaataacttactattattgtgttgcaggctatgtctccttttagactttttaaagtttgctttatatgttaggtgctgtggtgttgggtgcatatatatttacagttgttttaccctcttgatggatggataccgttcttactatataatgatgttctttgtctctttttgcagtttttttccttaaagtctgttttgtctgaaataaatgtagctaccctagactttttttgtttccatttgcatgggatgtctttctccatcccttcactttcagtctgagagtcctaaagttaaagtgagtctcttgtaggcatcctatgttaggtcttttttatccattcagccactctataccttttgattggataatttaatcatttacattgaaagtaattactgacaagtaaggacttcctagtgccattttttaaattggcttcttttttttttttttttttttgtaaatcctttgtttctttttcctctcttgccttctttgtggtttgatgactttctatattggtatgctttggatcttttctcttttgtgtatctgttataggcgtttgttctgtgtttaccctgaggcttacagaaaatatacttacaataggccattttaagttgatgacaccttaattttttttattattatactttaagttctagggtacatgtgcacaacgtgcaggtttgattcataggtatacatgtaccatgttggtttgctgcacccatcaactcatcatttacattgggtatttctcctaatgctatccttcccccagttccccacccccagataggcccaggtgtgtgatgttccccaccttgtgtccaagtgttctcattgttcagttcccacctatgagtgagaacatgtggtgtttggttttctgtccttctgatagtttgctgagaatgatggtttccagcttcatgtccctgcaaaggacgtgaactcatccttttttatggctgcatagtattccatggtgtatatgtgccacattttcttaatccagtctatcattgatggacatttgggttggttccaagtctttgctattgtgaataatgctgccataaacatacgtgtgtgtatctttatagtagcatgatttgtaatcctttgggtatatacccagtaatgggattgctgggtcaaatgataatcctagttctagatccttgaggaatcaccacactgtcttccacaatgattgaactaatttatacacccacaaacagtgtaaaagcattcctatttctccacatcctctccagcatctgttatttcctgactttttaatgattgccattctagctggcgtgagatggtatctcattgtggttttcatttgcatttctctaatgaccagtgatgatgagcattttttcatgtatctgttggctgcatagatgtcttcttttgagaagtgtctgttcatatcctttgcccgctttttgatggggtttttttttcttttaaatttgtttgagttctttgtagattctggatattagccctttgtcagatgggtagattgcaaaaattttctcccattctgtaggttgcctgttcactctgagggtagtttcttttgccacgcagaagctctttagtttaattagatcccatttgtctattttggctttcgttgccattgcttttggtatttaagtcatgaagtccttgcccatgcctatggatgacaccttaatttttatcacatacacaaagtctacacttttatttttcctcctcacacattttgtatttttgatgtcatactttgtctttttataatttgcattccttaaaaattattgtagctttagttcttttaacagtttaacctttttattagaaatataattaattggctgagtgcagtggctcacacctgtaatcccagcactttgggaggccgaggtgggtggatcacaaggtcaggagttcaagacgagcctggccaacatggtgaaaccccgtctctactaaaaatacaaaaattagccagacgtggtggcacgtgcctgtagtcccaactactctggaggctgaggaaggagaattgcttgaacccaggaggtggaggttgcagtgagctgagatcacaccattgcattccagcctgggcaccagagtgagacttcatctcaaaaaaaaagaaaaagaaaaagaaaaaagaaatataattaatttacccaaccccattgtattactagagtattttggatttgacaatatacagtcatatatcactttacaatggggatacattctgagaaatgcattattaggtgattttgtcattgtatgaacatcattgagtgtatttacacaaccctagatggtataatctactatacacctagtctacatggtatactcttttgctcttaggctacaaacctgtacagcatgttactgtatggaatactataggcagtttgtgacacaatgataagtaattgtgtatctaaacatatctaaatatataaaatatacagtaaaattgccgtataaaattgcatagggtacttattgtgaatgaagcttccaggactggaagttgcgctggattagtcagtgagtgagtagtgagtgaatataagggcttagaacattactgtacacttttatatgactaacggagcagtacatttgtttacaccagcatcaccacaaacacaagtaatgctttgtgttacagcgttataatggacatcaccatcactaggcaatatgagtttttcagctccattataattttatgggaccactgttgatgtcattatgtagcacatgactatactctcttatgtcttcatgttactaatagtgtcttcttccttcagcatgaaaaactccctttagcgttttttttgtaaaagaggtctaatggtggcaaatgcttaaactttttgtttgagaaagtctttatcaccccctttttttaaaagactgaattgctgagtatagagttattggttgatggggtttttttttttccttttaggatgttgaatgtatcatctcactctcttctgacctgcaaggttgctcttgagaaatccactgatagtcttatgagaaggttcttttgtatgtgatgatttgcttttactttactgctttcaacactctgtgttttaactttttataattttattgtgattgtcttggcataggtttctttggattcatcttatttggtattgtttgggcttcctgtctctggctttctatcttcttacccaggcttgggaagttttctgccattacttctttggatgtgttttctatccctttctcttctccttctggcatgccaataatacgtaagttgttttacctgatggtgccccataaattgcttgagctaccttcactttttcttttcttttttctcctcagactggatgatttccagtaacctgtctcaagttaaccaatctattcttctactggatcttacctactcttaaacccctctcttgaatttttcagttaagttatagtactcttcagatatatgattttcaattgataattttatgctttctctttgttgatgttctcatttttttcttgcattgctctgttgaccctggtgagcatctttttgaccattattttgaattttctctcaggtacatcacatatctccacttcacttcagttagtttctagagatttaccatattcttttctttggaatgtatttccttgtttcttcattttccatgactctctattttggtttctgtgtattagataagacaactacctctcccagtcttgtcagacttgtctcatgtaggagaaagttctcactaatctgtctggccaaagattttaaggtgcctctcaaatattcgagttcatccagactgttgtctctgtttagggttgcactgtggagcttaagatgtgccatgttctgccagtacctcaagacagggaagttaggagccagattatcttagatgtagctggaaagattggggtgttggctatgtgtttcaattacttccatcttcatggtgaagctgaatgtgggtgtctatttcccactctttctgtgctaagccaggtagaggatctatggcaaatgtctgaactcatgtttaggctgtgccctcagatcctggggagatagctgctggatgtgggcccattgtatgtccacctctttttttcttggatctaggaccactcaagaatgcaaagtcccatcaactcccagagctagtttgttaagaagacattaccttgggtggaagttatagaagttatggcacttgctgtgtaatcagacttttttcacgtagaatgggggaggcctagatttatcataggggtaagccaaaggaaaggatcatgaagtgtcaagctctgttttggctgctgcagagctatttgtttgccctgttagctccccagtgcaagtccattagaagccagcttgtcaaatgaccacttgaagtatgttataagccccttctggagagaagatggaagctacatgttttcacccctttttgggacttttccaaggggatgtagccgttagaagtgtttgcacacttgttcaagaccacccctttgttctgtgatctaaggagactcacatatgcctactatcttctgctgtcagagctaagagtagtttagagagggaatatttagggaggtgctataaaagttggagcacttgatatgtggcataaaccccatttgaggagaaatagctgtttttaaagccccttctctgcactgcccctatggtatgacgtccctgaaatgcctacatgcccatataaaactggcacttttttctgtggtgcagatagactcacatatactttgttccctctggtttcagagataggaagtttaggacacagtccgttgagtgggagctgtaaaattgtgggtgctcaatatacagtcagactctcttccatgagagattaataaacctggagttacctctggcatgagccaggggagaagactcaagaagtgccggtccacttcttaggctgtcagccaagctatatttgtctgcctctttaacttcctgaagcaagttcgttagaagacaagcaggcatgtagccaccagaagagtgtgttatagattccttccaggcagaaagaaggggctgcatattttaggccccttctctgcactgctcttgggggatgaagccccagaagtactcgagtgcccatagcaaaccaccacaattttattgtggtctagagagtcttgggtgtttaatcctctttgttctcagagccggtgaattaagaaccagaccatgggaaaccttagagttagggttctacatgtgagtacaaatcctcttctccacaggaagaagcttgatattagggagtcctttccagataatgtggagcagtgtctaaggcagggtcctatgcctcagcttttccttcccatttgatgtggaaattttcttagtcgcccagtgtgtaggagtctctcagctggtccctgactttctctcggagggaactgattcgtgaatagatgtttatttggtgcttttgtgggtggagggagagtcaggagcttcctgttctgccatgttgctggcatcactacctcttacctcctgctttttaatgattattgttggagtgataaatctttctctgtcctttcacttttaatctgtacgtgtctttatatttaaagtatgggttttcaaatattgtttgttctcacttacaagtagaagctaagctgtgaggacgcaaaagcatgagaatgatataatggactttggggactcggggaatggtgggagtggggtgagggacaaaagactgcttattgggtacagtgtgtagtgctcagatgatgggggcaccaaaatctcagaaatcagcactaaagaactcatccacataaccaaaataccacctgtaccccaaaaactattgaaataaaaaataaaatgaaatatgggttttgtgtaaacatcttatagttgggtctttttttttttttaaatcaattctgacaatctctgtcttaattgatatatttagaacattgatgtttaaggtgattattgatagaggtggattaatatttagttagtttgttttctgttgttataactaaatacctaagactgggtagtttataaaaaaaagggatttatttcttagagtgctggatgctaggaagtacaatgtagaggtggcacatttggtaaaggccttcttgctgatgaggactctctgcagagttctgaggtggtagaagacattacatggcaaggggcctgagtgtgttaactcttacttctcttttaaagccactaatgccccatcctcatgatctcatctaatcctaattacctttcaaaggtcccacctctcaaataccatagttggatttcccaccctcttaatactgttatgatggggattaagatttaatatgagctttagggccagggggacaaacattcagaccataacatgtgccatatttgttactatttttatttgttgcccttgttctttgtccctatttttgtctttgatgctttttatgccttttatggttttgagcagtttttatgattccattttctctcctcacttagcatatcaattatatgcctttttaaaaactttttttaaagtggttgccctagagtttgcatatgcatttacaactattctaagtccattttaaaataacactatacctgttcacaggtagtgtaagtacctcgtaatgacagaatattcctaatttctccttgtccttagatctttcatctcattcatttcacttatacataagcataattaaacatgtatatatacctatgcatatacaattaaatacgttgtttctattaatattttagacaaactgttgtctattagatcaattaagaataagaaaataaaagtttttatctttcaggttttttttgtctaatgctctacttttctctgtatagatctgagtttctgacctatgtcattttccttttctctgaagaacttcttttaacattccttgcaaggcaggtctactagtaataaatttcttcaatctttgagaaagtctttatttctcttttactttgaaaggataatttttcagggtacaaaattctgtgttgggatttttctcttttagcactttaaatatttcactttactgtcttcttgcttgcatggtttctgaggagatgtcagatgtacttcttatgtttggtcctgtatagcagggttcccaaccatggcctgttaggaaccgggctgcacagtaggaggtaagcggcaggcaagtaatcgaagctatgtctctatttatagctgctccccattgctcgcattaccacctgagctctgcctcctgtcagatcagtggcagcatgagactctcataggagcatgaaccctatggtgaactgtgcatgtgagggatctaggttgtgcactccttatgagaatctaatgcctgatgatctgtcactgtctcccatcatccccagatgggactgtctaggtgcaggaaaataaggtcagggctcccactgattctacattagggtgagttgtataattatttcattatatgttacaattgatggtggcatcagcccatttggagcaactgctgaggggatgccagctgcagtgtgggaggtgtggccagggctgtacgctccatggagctggcaggggccaggaacaggtgagagccctgcctgctaccaagttggctccccacacacccaggtgaagctacagccacccagccatggctctggacctaggcatccctgcactcttgggggcccaggaagccccccttcccctgaaggcttggaagtaccttttcctgctccctggcctttccccactcctgactgtcactccaatttcagagcaaagttgaagccaagcctgaacactcttgtgacctggccaggggtgccaccccactgccttggctccttctgaaactgtgggtgctgacaagctcagggagggaggatgtcggggggctgaaggtagctcagcatgggcctacaggcctccctcatcctgaacagcctgggcaacatggatggcatgttgatggtggcaggaagcaggcagattcattcctaggcaggaaggggtgggtcactggtgaagccccaccttcaagccagggacagcctgaagcctgagggctaggctgccggttctggatggagtccacaacctgaagtgagaacttatggtgctttttccaggtccacccgtggaccagtcagcatgcacttcctcccttctgagcccacaaaaaccccagacccagccagatgcacacactcatcaggtcaacctgcctgcagaaaggagctacccactataggtctcctctctgctgagtgctggacacttgtcagtacaacctgcctgcggaaagcagctacccacttcgggtctcctgagagctgttctgtaactcatgaagctcctctccaccttgctcaccctccagttgtccaagtacctcatgcttcctggagatgagacaagaatgcaggacctgttgaatgatgggactgaaagagctgtaacacaaacagggctgaaacacgtccctcactcaccacattgtgggtgacgagaaggagtgaagagctgcagcccttttagctgcccaaacattggggctccctgagccagggctgtgacatgctttaacaccctctttggggctctgcagttcctggtgtctccgagtttttgggcaccatcgtgttccctttgttcagatgctggtgcctgcagtagaagctgcttatggtacgtctggtccagctgcagcctcacatggaaccggtacctggagctgcccgctccaccacagctggcatgcctggctgtgcacagtggctggacaccacactcattcactgacacacctgtggccgtcccatgcctggcttgccattggcagacatgagatctgggccggtagtagtgtgagccaagcgcagcctgctgggctgaatgggtggaacaagcccagcagatgtgagtaaaactcatgcagcggcacctccaaccacagaggtttccagctggcaaagcgacatcctaaggatcctgtgacatgatgtgataatagaaataaagtgcacaacaaatataatgcacttgaatcatccctaaaccatccccactctggtctgtggaaaaattttctccacgaaaccagcctctggtgccagaaaggctggggaccactgctctataggtaagctgtttttcttcctctggcttcttttatgatttttttttaatctttgattttctgaagtttgaatggaatgtgcttgagtgtagggttttcttgggcattcattttgctggtgttctctgagcaccctggatttctaatttattgtctgacagtatttcaatgaaatgttacacaatattgcttcacctattgcctctgtccctttctctctttattgttattcttttattcccatcacatgtatgttacaccttttgtagttgtcccacagttcttggatattctcttcttttttgttttggaagttttaattgacgtattttcaagttcagagattctttcttcagatgtgtccagcctgctaataaacccattaaaggcattctttatctttgttagagtgtttttgatctctagtatttcttttttattgtatctcagaatttctatttgttaactttatccatctgttctttcatattgtctactctttccattagatctcttagcatattaatcatagttgttttaaattcagtttgattatttcaatgtccccgccatatctagatccgattttgatgcttgttctatctcttcaaactgtattttctgccttttagtatgccttgcaatttttttgttgaaaggtagacatgatgtactaggaacaaggaaaattgtggttaatatgcctttagtattgcagtgataaggtgttggggaagggaaaggattctatagtcctgtgattaggtctcagccttttagtgagcttgtgtccctgggctgtgaacttcacacgtgcttctcagttttttgcatattcacccccttgggtggtaccagatgactggaaggggttggaggtggatattgcccttcttccaggtagataaggctctggtaaaatagttccttttgaggacaggcattgttaagaacaggaagttctggcgtatttctaaatggttccttttccctctctctgccagaagcaagagtagattttactctcatcttcactgtgagttgctggtagagctctcagtggtaaaactcgcagaaaatctaggggtttccctatgatggggtccttcttgatttttccactgtgagccattagcaatttgctaataatagttcaaattttcttgcctgtttttcttacataaaagtttatgctcatgaatttctgctcagctaagttgtggttctctgtatctgcctgaccatcttcagttttggggcagtaatttgtcctctgatctcatttctctgatgggtctaagaagttactgatttttttgtttagctttttacttgttaggttgaagtagtgacttgtaagctccttgtgtgctagactggaaaccaaaagaattcacagctattttctcctgtgtttcctttctttctttatagttttacactttacatttaggtattgaattaattttggattaatttttatattacatgtgaggtatgatcaagattcattttttcttcttgcatgaagatattcagttactccagcaccatttgttgaacagattatcttttctccattgaattgcctttttattttctataaaaaatcacttgaccttctatgtgtgggacaacttttggattctgttctgttccagtgttctatctgcctaacctttttccagtaccacactgatttgattactgtagctttgtagtatgtcatgtgagacctccaagcttgttttttggtttggctcttctatctcctttgcttctctatataaatcatagaatcaccttgtcactttatttattttttaaaaaatcatgctaggattttgcttgtaattgcatttaactacagaacagtttggggagaattgacatcttgaaaatagagttttccaatttttaagaattgacatcttgaatatagagtttatttcgtctctcaatttggttgtcatgatttcctctgtcagtgttttgtagttttgcatagagattcttgcatgtattttataagacttatacccagatattccatatgttgacttgtgtcctccagccttgccacactcgtttactagttctagttggtttttagtagattatttgggattttctatctaatcatattgtctgcaaatttaaacagttttatttatttatttttcagtctgtatgttaattatttcttttccttgccttatttcagtggctagaacctctagcatgattttgattaacagtgataagaaaaaaatcttgcttttttctgatctttgtaggagatgaggaaacattcagtcttttatcactaagtatgttaaatataggattattgtaaataccctttatcaagttgaagaagttctcttccgttcctaattttttgagagttttatcacaaatgattgttgagttttgtgaaatgtattttctgtatctattgaagcaattgtatgctctttcttccttagcttattgatatggcgaattacactgattaattttcgaatgttaacttcaccttgcattcctgggataatcctcacttggctataatctgttatccttttatgtattgttggatttgattcacttgcatttatgaggattttcgcatccatattagaggtactagtctataggtttcttataatatgtctttgcctagtttagtatgacaattcagttatgacaattagtatgataattctgagttcattaaatgagttgggaagtgtttactcttctctattattgaaaaatttgtgttgcattgacattatttctcaaatatttggtagaattcactatgaagccatctcagcctgcagatttctgtgttggaaggtttttaaatatttaattttcaaaacaaataaaggattatggaagttatctgttcctttttagataaactttgcatatttcaaaaaaatttgactattttgttaagttatcaaatgtatggcatagagttattcatagtatttccttattattagttcattataggatctatagttatgccccctctttcattcctgatatttgtaacttgtgtctcctctttttttttttttttttttttttggtcagtctggacagaagtttatccatttttatcaacaatagttattcttaacgtactcatgtttcatataccttttaatgagctttagttatattttatttaaatatccaagaatctctaagatactttctattgttatcctcttttgcagattaataaagtcaggcttgtatatattaggaaacttgcctataattcaacagctagaatgacagctctaggattcaaatcaagtcttgttgactccaaagccttttcttctgaccattctgctttattgactggtatacaggacaaataaaaatcaacaagacatatgaagagaatcccttccctcatattgtaactggaagcaaacttttcattttcatcattggaatgtaataattactattctctatcactggacccttttctgtaaacagcgtatagtacacaccctctgtcataaggtctctggagatctgtttgccccttccaaaagtttagaccactcgaccagaggacctacaaggagagacagaaaatttgagaacttctggttgctacaaaatactggagaacacaccttacatttttagaacataggagcttatgaggccttccagtgactagatatgtgaagcaattgtcctgatgccatccattcttggttaactgcaaataaaagtctttatgcccttctctttaaaatgtaggcatttctttcctttcataggttaagatatgccttttttgtttttttaagacaagatcttgctctgtcacccaggctggagtgtagtggctctaatatggctcactacagccttgacctcctgggctcaagcgatcctcccgcctcagccttctgagtagctgaaattacaggtgcacacaccactgtgcccagcaaatttttaaattatttgtagagacaaggttttgccatgttgtccaggcaggcctcgaactcctgtgttcaagaaatcttctcacctcagcctcctaaactgctggaattacaggtgtgagccactgcgcccagtcaagataatgcttttgaaaataaaagttgatatggcttgcttgtttcctcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctgggtaagagtttctttaaaatctatgggaataatgagattatttaatatatgcttaggggaaaatgtgaaccttgttgagctataaggtatgtttggtcctctttgggatgatcagttaccacccttcaagacacacattagagtttttccttattagaccacagaagtgtgtgaggaaataaaaatgagctattgggaaagagaaaaggaaaagtaaagtataaatgtggttgactaaactagtggaagggatttttgaagagctttcaatgcaggattcaactcattctctttttcattcagtaaacattgtatgtgtactctgggcatatttctgtgttaggaattttgaaaagttcaaaaagaaaaaagaaatcatagtttccagcattctccttataaatcctcatggaaggttgattacagcatatggaatactaaatagtaaataatgtaagcataagatgaaatgccttttgtgattcaaagaggctcaggattgagctgtgtgagtccctggctacacataaagtggaggaaaaaaataagccaggttcagacagaaatctcacacaggcactgaaatggttataggaaacttacctggctacaaaggctggccaccaaacaggctgccaggtcattcaagcagtaacagggctagaactgtttccgtcttaatgctgctattatggatgtgaagccaactgatcagacaggtagggctgccagcagtgtcttctaatagttatgagtacttgggagccaggcagacactggtatatagagattctatgagatctatttgtatactccagcaaaaaattaatggaggagtgaggtagagggagggggggagagtaggatatagcccaccagaaaagatacaagaaagaactattagacctattcatttgttcgttcactaaatatatatactcattaaagacctgctatgtttcaggcattgtgctagatgctaagaagtacaaagatgaatagaacattgtccttcaggtattcacggttttattagaaaagatagataaaaatgacagcaaagcgataagtccacaatagaagtgttataagaaaatatactttaattattgcttctaaactctttgattgaggaaatcagaagtatagtttattaagtgtcttcagaggctggtttcttttctcattatatctccatttaatgagctttttgtgctatctgtaagtatgttgtaagttccaaaatcagcattctgtagctgattctgttcagttattgcaccaaaaggccaggcagtttgtcataaccacagctactttgtgcactggaaaaatgctttttccactctatgtggtaaaggactggttttgacttattttttactccatcactgagaaatattgttataaaatacaagaaaaaataattattaaaaatgtgaaatgaaaaagcaatgacatacaaatatttcagtaaattaaatccaatactatataaaaagggttatacattataaccaagtgggtcttatcccagaaatgaaaggttggtgtaacatttgaaaatcaatcaatgtattagactaaaaaacaaaaagcatatcccaatagatgcagaaaatgtatttgatgaaattaaatactcattcataataaaagttctcagcaaactagaagtttctttccctgtttaaatgctatctatgaaaacctacatgaggctgggcacaatggctcacgcctgtaatcccagcactctgggaggccaaggcaggtggatcacctgaggtcggggattggagaccagcctggccaacatggtgaaaccccctctctactaaaaatacaaaaattagttgggcatagtggcacatgcctgtaatcccagcaactcgggaggctgaggcaggagaatcgcttgaacctgggaggaggaggttgcagtaagccaagatcgtactccactgtgctccagcctgggcgacagagtgacctctgtctaaaaacaacaacaacaacaaaaaacacctgcgtctcatacttcatggtgaaagacagtgttttccacttaagattaggagcaaattaaggatgtcagctcttctcatttctggtcaatattgtactagaagtatggtcagtttagtaagaaaaagaaataaaagacattcagaatagaaaggaagaagtcaaaactgcttgtattctatgtggcatgattgtctacatagaaaaacaaaaagaatttaagaaaagctactagaacttataagtgaatcttaaaaggtcaatgtataaatattaatttctgtttgctagcagtgaacaactggaaattgaaataaaatatacatttataatagcatctccaaataggaagtatttcaggataaatttagcaaaatctattctacatttatacattaaaaactgcaaaacattaagaaaattaaaaaggacttaaatggagagatagatacctagtttcatctatcagacttaatattgttaagatgcaagttctccccaaagcgatctgtagaatcactgcatttaaaaaaaaatttgtttttgagacagagtctcactttgttgcccaagttagagtacagaggcccgatcatagctcactgcagccttgaactcctgggctcaagccattcacccacccctgagtagctgggacttacggggacgcaccactatgcctggctattttttaaattttattttctgtagaggtggggtcttgctatgttgcccaggctggtctcaaattcttgggctcaaatgttccacttgcctcggcctttcagagcactgattacaggcatgagccaccatgcccagcccagtgcaattctaatcaaaatcccaaacaccacctgttccccaaaaacctattgaaattaacaaaaaaaaaaatcccaacaagcttttttgtagaaatcggcaggctggttttaaagtttatatagaaaagcacagaatagccaaagtgactttgaaacagaacaaatttggaggacttacgttgttttaagatttgctataaagctgtaattatcaaaacattgtgacattggatagactcttcaatggaagagaataaaggtccagaaatagacccacagataatgtcaattgatattcaagaacgatgtcaaataattcaacagagaaaggatagtttttttttaattgtgctagaacacttgactatccatatgttttcccacctacaaagacctatacccaaatggtttatagcagctttgttcatattcacccaaaattatataaacaacccagaagtttatcgactgataaatggataggtaaatcttgatggacccataccatggaatactactagcaatataaaggaacaaactgctgatacacacatgaatcaacaacgtggatgaatcttaaaacccttatgtgaagtgaaagatgacaggtacaaaaggctatatagtttgttattccatttatatgaaatgctacaaaaggctaaactgtaaggagaaaaatcagaaatttctgctagggggttagaggaagagaatgactatagaagggcatttttttaaaagatgacttttactatatgtaaattatgccacataaccgttaattttaaaaatataaaaatgcatatattttatttgtagattcaacagacatgaattcactctgcccagttgctattgaagtttccaaacacttactcttcccatactcatctcttccctgcttggtaacagtgtatgagtggcaagttcacagctgaagcttggggtcaggacagtatacctacatttggaaggttatgtaaagtaataatagtgcctggggaggcgataccatttatgatcagtaaaatccttttttaattggagtgacatcttccaaaggaaataatttgaaggataaatctttagattggattttttttttttgtctgttggaaaggagaagacataaagctgtaaagctagaaggtgagagatttgaactttaattattttgctactcatatttatagtcaagttttcattatttctcctttaaaccatctgtcaaacatgtaatatatagttatacgccacataacatttttgccagtgatggaccacatatatgatggtggtctcataagattagaataccttatttttgctgtgtttagatatgtttagatgcacaaatacatgcctttgtgttacagttgcctatggtattcagtacagtaacgtgctgtgtaggcttgtagcctcggagcaataggctataccatatagcctaggtgtatagtaggctgtactctccaggtttgtctaagtacactctatgatgcttgcaacagaacagatcgccttatgatgcattgctcagaacatagcctcttgttaagcaacctataactgtatattgaaaggagttttgcctgagaagtactttgagtattttgacttaatgtagatttctcaagagctgcttttttagaccaccgcactgtggtaggcattgttattgtggtattactgtgcaaaaatgtgtattattatagtttcaagataaggttctttccttgtttctgttttgtcttagccactatctagaatttaatacctccttgaactatgacatggatcacaaccagtattttagccttgcaatttctttacatttacgtaagaatttttacttttctgagcattttaacacatagatttcatttaaagattactataattatttaatgcattaaaggaattacaggatctttgttctcctctagttattattgtaaaactagcattctattttgttcctcaccccacataactaatttctgggttcataaagacatttgtacaattttattatcatgcattttaaaagatatttagttcctaaatattacataaccatgtaattatgataactctattcagtggtttgtaccttttatttctccatcttgaaaaggtttcttttttcttgatcaatttagtgaagacattttctaattaccttatagtaacagagcttgggttcttatggtctcctctgatcttactgaacagttcatttgtagcctattcccagggatgacaggaccaccatgtgctcactggcatctactagtagctgcttttgatttgaaatgaaatgtttctaatacatgctggcctgaaaatttcaaccagacttcacatttctcacatggttcaataatttaggctgggtacagtggctcatgcctgtaatcccagcactttgagagactgagagaggaggatcccttgagcccaggagttcaagaccagactgagcaagatggcaagacccccatctcgatacaaaaaacaaaaaaacagccaagtacagtggtgtgcgcctgtagtcccagctactcaagaggctgaggaggcccttgaacccaggaggtcaaggctgcaatgagctatgatcacgccactgcattccaggctgggcaacaaagtgacatctctttaaaaagaattaaaattttatttaaaaacagagcatacaacctggatttgagtctcttctgtcttggattattcggttctgtgttttccatacagagaatgtggcctgaaacaagaacccccaggcggagcagatgcttccaatagatcaaacactactttaaactgccaccgttgccactcaggacaacaaataccaacaataacaacagtgaatatcccttcatttaaagcaaagcaaaattaaattgttgataattttgttaaaaataattcagttaaagagctttggggtcggagagacctagaataaattccagccactgttactacttttttaatattgtgggtgataactgtcgtctctgatacaaaaataacacccttcttacagggatattctcaaatagagttcatgtatgtcaacttaggcctgggtcagaagatacttatgactcttcaaaattattttatttcatatgtatataaaggtgtttataggattctctgtatttctgaatgcatttacatctccaaaatagtttcagaaatattatatcaacaccattaccaataatcacaaaaaactaatattcaagctctctttgcagtcctttattgtgcttagatataccactgaggttatatgttgttaaagtgcatgttcaaaagtagtttgaatgcttttctttgtgtagttatattatttattcgatatacagttaagaagttgtctttgaaacttctgttttcattcacttataacatttgctgtttttaccttttttatttaattgtattttccaaatttgcaaaatatagcttgttttaacaaagtcaaacctatataaaaagacatgcaaaagaaatcacattcgtatccctaccctttccattctgttttcttccatccctgatagatattcattggtttctgatttgtccttcctatgtttcttttttttggaaaaataagcaaaacccatggggataggtatgtgtgcctgtttatgcatctcccctctttcttatccaaaagatagcaaactgcatatactccttggcactgcttcagtggtatcccatagacgattatatgtagtattcttattatcatcgtgttttagaaattctgcagttttgttttgtatcccctttctcccaagagttgcttagagagtttttagtctctaagtagaaggaccactttttgatgtgaataatttctagttttatcccattgtggtcagagaatgttgtttgtgttgtttctttaaggaacttcatgaggtttttatctttgcagcctaatataaggtcaatttaatactggcccttttatgcttcaggaattatattctgtataatgagaatataatgtatatatattatacacacacacacacacacacacaaactgtaccttataaatgatgttatttaggtcttctatatccttacttaccttttgtttgtttgatgcattttagaccaagagtggtgtgttaaagtctcttattactgggtttttgtttgtttctctttgcatctcttgtaatttctgctttatgaaggtagttgttgtggcctttaacatttgtacttccttgtcttaaatgctttgtggcctgaattttaccttgcctatatcaggatcacaactctggatttcataatatttatatttgtctaatatatctttgctcatttctttatgtttagccttttgatttcaatctgttcttttgtatgcagcgtagaattgggcttagctttatgaacaatcgaaaaatcttttaatgtgttaggtaagcacacttacatttattggtataatcaatatgcttggtgtcaacggttttatttttttaaaacttactgtgtttatttttctgtgcatttaggaaggtttgcttttttttttggaaacaaagtcttgctctgtcacccaggctggagtgcagtggcacaatctcagctcactgcaacctgctcctcccaggttcaagcagttctcctgtctcagcctcctgaagctgggactacagacacacgctaccatgcctggctacttttttgtgttttagtagagatggggtttcaccatgttgcacagtctggtctcaaactcctgagctcaggcaatctgcctgcctcagcctcccaaagtgctaggattacaggagtgagccactgcgcctggctgcatttttattataggttaggggttggcaaactttttctgtggagattaggatagcaagtattttagactttgtgggccaaactgttggaactactcatctctgctgatgtagacggtataactgtatcaatatgtctgtgatgtaaacaagagaagccataatatgtaaacagatgggagtggctgtgttccaataaatttttatttattgtaacagattgtgggctgcatttggactgtagtttgacaacccctattctagggcttacgttttataataccttttataatgcctacagcctcatttctcctcacttgggaactttaaataatatcatatgactccagtctgttagccatgtagtaatcagtgagcctattttactttcccctttctcccttcttctcttcacttaaataaatagttgtattatttgtactttgtcagaacaaatagcatttacttactattcttccacttttatgctttcttttgctttggtctatctaaaatgaagtgcttcaccattggtctttttgggagggccagggcatcatcatcatctcttggttgaatgaagcccatcctctagcagatgccttaggaggggctcctgattattgtcttgaatttttccatgtttcaaatcatttttcatagcattgacacttgaaaaatgaaagatagcttggctggatataaagaccttggcttatactttctttcctaaagtcttgctttctatgttgctattgacaaatctgatgccattctgatatcacttgctctaaaggtgatttagtttttttgcctgaagtcccagagggttttttcctttatctttaaagtataatatttttactagactatgtctcagttgattattcctggtcagtttttctagatatcagtgagcttttgacatgtattcttttatccctggaaatttttattgaatgattgtttgacactctagttcagttctttgttttgtttttatttttcagaagctgtaattatttatttgttagaatttttcctaggctctgcagcaaccatttttttttcttaaacttcttagctcatctgtattttgttttattctcttggctatttttattcctctccttagcaccctttattatattttcagtcctgtcggtcctttcttagacaccttagattcaaatgttaatttcttttttttttttttttttgaagattcatggggcacatgagcatgtttgttacatgggtatattacataatggtagggcccatcgcccaaatagtgaacacagtccccaggaggtagtttttcaacccttgtccatgtcctttgctccccagttttggagtcctcagtgtttgttgtttccatctttatgaacatgtctacccgttgtttagctcccacttaaaagtgagaacatgcagtgttcgattctctgtttctgccttaattagatgttcatttctgagagtatttcctcttcctccctttacatccatttctttcttcagttttatcatctctggatatacatcttctgctttttggtgcttttatattgtgaatttttgaatttctgatttggaatggtttttcctatttgcaaatgtttgcttaaggatattcaagtcagggcactgtgttacagatttcctttgctttgtggggtttttttggggcagggtagggagatgagggttttatcaacggaagtatttttattcttgtagtagttttatggagctgcatgttatttccattcattttaaaatgtcttatgtttttctgaatcattattagtaggtattctattaaggtgatggtgaggttggatggtatactaatttttagttcagaggaatctcagttaagtgcattttacttaatagtgttttccataaggggatggttgatttgtctgttttgtggttcttatttgtttctataggatgtttaatatccactgcttgcctccttcttcacctgatcaccaagactccaggcgactcttgccccttgccggtctcctctatctactccgggatccttcccatgactgccagctctggtccccggaactttcaggcccctctgtctattctccagtagtcaatgactttgattcacaaggtctgaaacctgttctcaatatttccccactctacatgggattctctcctcctcctggcattttatctgtgttctccagcatgaggcccccattactttctcctcctttcacttagtctccactgatctttccactccagtaagggctctagagttagctttgctggtttctggtgtttatttctctatttatatataaactgaagtttgtagtattcttccactttctttgttagtttttagtttgatgagttttgttttatgggtttatttgcttgctttgtttatccgtaaggtctttggaggatatgttgaagtatggctataagtagctgccattatcatatgggaacctagaaatcaacatttcattttttaaagttattctttcttatattatttaactcttaaatgttgacttttactgtatattttatatatttttagtatattactcatttctgaaccacatataggaaaagtaattggagaagtggttgtctacaattattttgaagagctcaaatatagaaatggaatgagatttgttcatatcctttagaatcaatggctggaaggttcagggaagcatatttaaaattagtacaaggaagacttattaatggttagcgctgcctaaagatcaggtaggttgcctctagggttatagaggccttcaggtttagactagaaaaaatttctataaaaaattcagttatccagtgagtaaatagataacctttagggttaacctttgccacctatgacaggctgcagatcatgagctggcctacaaattcagctgtaggatggtttattgtagactatgtacataaaatatggttttatattttattacaaaacattgaacatcctgtgctagatatggaaaaagttcaggaaacatcaagagctctccctcttctccagtggaattgaaaaaataaagtaaaaaacaaccaacaaaaaaatttttttaaaagagctccccgcttttttagtgactgcaaaaatacactgggcatagacagaattactgtaataattgagggcagagagtccagagctagtctgggctatatggcggttccagcttcacaacttgctagctgagcacattactgaactctccgtaactactgttctactgtaacataatttgggggaaagggagtttatttaaagtagatgtatatatattagcagctgtattatctcatcgccaccacagcatcagaagtttattcatcttcaaacctattctcttcgttattatgactcaggtactttctgttgctgatttttttgtgtgtgtttgtgggtcttttaggcttattcagctgttcttagtagatgagttctccttcctgtctccgtttcaaatgccctctagagagacccagttaaatacagtcatccatatttaaagatttatgcaagaccaactctagactcctggctagttcattgattggctgctcttgggtcaggtgccaatcactgctgtgggcagctgttcctgtatggctgtttacacagaaggaattgtggggttatgtgcttggggtactttccagtgtttggcctgtccagaactgtaatgaagacaaagaatcacttaagaaatatactaaagaacaggtgataaaacaagagtctgtttgtcagcgctgggaaacaattgtttagacagacagaacagtctggacaatcagtgtgtataggaggtaactcttcatgagaaaagtcttgagttcagcgggtttcaaagagacaggcaaaaaggatggcgagggtttaaagacagtacttagtcttctgtacctattgagatgaagactctagttcaggctctgtaatagtttttacagtttctgccaagatcatagctgtcaccaattacgtgatctgttttcttccatttaagttgtccttttaattttttttttttgtattttttaactttgcttttgacataatatcacttacagaaaggtacaagaatagtacatgttggcttttttggggttgtttgtatgtacccctagttacaattgtatatctatcatctgtttggtggtgggaaccagtgaaaacactctaaaagttccacgttaactcatgtgttcatttttcataacactcactctgtctcactctacaatttaagaacaagttggatgagcctccacagtagttcatccaacttttttggctaccagttttcagaatcttaagttcattacccctaattagaggccagttaatcttcctgatgcaaagtgtacagttaactgccaaatgcaaaactcttgagaaaatgtctctagagacttatagcatgccgtgaagttaattaatagcagataagagggttaagtgtgcaaagggaacactttaattatgaattctaccaaaataaaatactctgaatctattaagaaaaaccttatctacttctccacctacaataggaatccttcactgagtcatcatcatctagatattctggggccctgcctttctaaccacttcaggttttcctttgagacatttggtaccttgccacatcattttcagaaactcttgaatatgtctgcttttgctttctttctctttttctctttctcctgtctcaagtgactaaagtttggctgatttgtgaagcagttttgatttgaattatcatttccctttaatgcaaaccgccggatcagaatatctgactggtctccaaggctacatgaaatttctcatatatatatatatatatatacatatatatatacatacatatatatatatatacacatatatatatacatacatatatatatacacatatatatatatatgttttgttttgttttgtttttttgagacagaatttcactcttgttgagtgcagtggcgcaatcttggctcactgcaacctccacctcccgggttcaagcaagtctcctgtctcagccttctgagtagctgggattacaggcatgcgtcaccacacccggctaattttgtatttttagtagagacagggtttcgccatgttggtgaggctggtctcgaactcccgacctcagatgatctgcctgtctcagcctcccaaagtgctgggattacaggtgtgagccactgcacccagccagagattttttttttttaatgtgtcacttatatgcactgcagagagttagttctttttttgaaaataagcacacttaagtgtctcatttaactgtgatttcacaaattgctcttttaagttgaggtcaaactttatgcagtgttttcctgtgggtggcacataccttacctacaagggcatatcataatccctactattcagatgcttaagcaactgggagaggccaatatgatttctgcactgcaaaagcttgttatagtcaaaatagaaaaaatggtaaaacacttaggatgcctagagcctactaaatgtgacttatgtcagtaaccaaaatataggtcttcttgaatcaatacatgcttgtgaagaccaataattttgttgttctttatgttacttaaatctggaaacatttttaaagtttgggaatttaattacttaaattttgtcctggctgcttaatgaaatagaagtaagatgaaaccaggaagcaaatgatgcaacgtgagttttttttaaaaaagggggctcgggagtggtggctcacacttgtaatcccagcactttgggaggctgaggcagaggatcacttgaggctcgtagttcaagaccaacctgggcaacataatgagaccccttttcttcaaaaaattttaaaaatagcaaagcgtggtgatgcatgcctgtggtcccagatactcaggagtctgaggctggaggatcacttgagcctaggaggttgaggctgcagtgagctatgattggaccactgcactccagcctgggcgacagagtgaaactctctgcctctgggggcagaaagggtgtcagtattaaaatctgctttttttaaactgtgcaaatcagtgcctgtgcctagtgaatggcagcacagtgccacatgacagtgtgtagtcatttgaataacttgatatgatgatgagctttaaggctgtaggatgctaaataaatcataatttgggaaagataatgtttcattattttcaaggttcttttcaaacttaagcaggatagcatctcatcaaaagcagggtatcactagatttttaaataatcaaggacatcctcaatatttgttgaagacacattttaggagaaaacttaacatttctatgatatatgtaatgtctactgaattatactcacatgcctagataggaagtacaacctgaaaattaaaaatggcaagataggccgggcacggtgtctcacgcctgtaatgccagcactttgtgaggcagaggcgggtggatcacaaggtcaggagtttgagaccagcctagccaatatggcgaaaccccatctctactaaaaatacaaaaagtacctgggcgtggtggcatgtgcctgtagtcccagctactctggaggctgaggcaggagaatcgcttgaacccgggaggcggaggctgcagtgagctgggatcacgccactgccctccagcctaggcgacagagcgagactccgtgtcaaaaaaaaaaaaaaaaaggcaagatagctcttgttttgctcagtagacgtatctttttgagcactaaacaatgtcatgctttctgctagctgctggcaccttaaagacgaaaagataaggcctttgttctcaagacattcacaaccgtgtaacaagacaggcaagtaaacgtttattgtatactgtgattctaacagccctagaagggccagggcacagatctaacttgactagtcatcagttttctggtgcaagcctacttaattagaatctgtaaagtgggacctgggaatctgcattgtcaaaacctactttgggtcttgttgatctgcctggcttaggaaccactgctattgtacagggtgcttgctcagtacccaagcaccctgtttgcctctgctttccaggatcttatgaagctgtatctgtggtggtagtcttcacagtctagtctctggttaagggggggccagaggagagagaggcagggagaagagggaaagtccttctgtccagccaaccctactgggtggtccctgacccctagggggctgcatgggctgtgaaacagatgaagtgatccttggaggtatccaagtgtgccaccaggatgtgaaaaatataagttcaaaccatgtactttgagagtttactgttctttctagattatttatatggtcaatacttttaccttttcctctttcctattccccttgcttgtaaatcccattactgttcattataccagtgtagatgtgaaaagtattttgtcaactttatcaaccttgttaaaaagttgaggaggagccaagcgcagtggctcactcctgtaatcccagcgttttgggaggccaaggcaggggcagggatggggaggattgcttaagcctaggagttcaagaccagcctgggcaacatagcaaaacactgactctacagaaagtacaattatccaggcatggtagctcatgcctgtagtctcagctacacaggaggctgagatgggaggtttgcttgagcccaggaggtggaagctgcagtgggctgtgattgcaccactgtactccagcctgggtgacagagcaagaccctgtctcaaaaaaaaaaaaaggggggggggaggagagaatatatgtacctagcattttaaggttaccaaatatatataatggattgtgagaataccattagtatagttttattttgcagttttattgggttttttaaaaaaaatgctaaacaatttttaaaaatcaaggcctgtcaatatagaaatgtcagacagtctacaaagtaatatgtcactgttgctgcgtgggctgttctctggcctgattcctttgatgagaagaccactcaaacattgttgggataggttttgccgtagccaaaggaactggagcttgctggagagattatgctacatatgagccagagtaggctaactgctatagcaaacagtgacttaacagaatgaaaggttattttttgctcatgtatgtgagggacactcagagagtcccatccttataatttcattaaaccaaatcacctcccaaaggccccacctcccaataccataacactgggtgttagggcttcagcatatgaagtggaggggacacaaacattcactccagaacagcttctattcttttgtgtgtgtggagaaaaaaaaaaaaataacataaaaatctaccatctacagttcagtagtattaagtcactctctggacagggcatctcagaaagaaaggcagcagccccagtcaggggcttatagataaaattcccatcttcctgggacagagcacctgggggaaggggcagctgtgggcacagcttcagcaggcttaaactttcctgcctgccagctctgaagagtgcagcagatctcccagcacagcgctcgagctctgctaggacagaaggcctcctcaagtgggtccctgactcccgtgcctcctgactgggagacacctccaagcaggggtcgacagacacctcatacaggacagctctggttggcatctggcgggtgcccctctgggacaaagcttccagaggaaggaacaggcagcaatctttgctgttctgcagtctctgctggtgatacccaggcaaacagggtctggagtggacctccagcaaacgccagcagacctgcagcagaggggcctgttagaaggagagataacaaacagaaaggaatagcatcaacatcaacaaaaaggacgtccacacataaaccccatccgaaggtcaccaacatcaaagactgtaggtagataaatccacaaagatgaggaaaaaccaacacaaaaaggctgaacattccaaaaaccagaacgcctcttcaaattctcctccacaattcctcaccagcaagggaacaaaactggatggagaatgagtttgataaattgacagaagtaggcttcagaatgtgggaaataacaaactcctctgagctaaaggagcatgttctaacccagtgcaaggaagataagaaccttgaaaaaaggttagaggtattgctaactagaataaccagtttagagaagaacataaatgacctgacggagctgaaaaacatagcataagaacttcatgaagcatacggaagtatcaatggctgaattgatcaagcagaagaaaggatatcagagattgaagatcaacttaatgaaataaagcgtgaagatgagattagagaaaaaagaatgaaaaggaacgaacaaagtctccaagaaatatgggactatatgaaaagaccaaacctacgattgattggtgtacctgaaagtgacagggagaatggaaccaagttggaaaacacacttcaggatattatccaggaaaactacctagcaggacaggccaacattcaaattcaggaaatacagagaataccacaaagatactcctcgagaagaacaaccctgaaacacataattgtcagattcaccaaggttgaaatgaagggaaaaatgttaagggcagccagagagaaaggccgggttacccacaaagggaaacccatcagactaacagtggatctctctacagaaaccctacaaaccagaagagagtgggggccgatattcaacattcttaaagaaaagaattttcggccgggcacagtggctcacgcctctaatcccagcactttgggaggctgcggcgggcggatcacgaggtcaggagatcaagaccatcctggctaacatggtgaaaccctgtttctaataaaaatacaaaaaagccaggtgtggtggcgggtgcctgtagtcccagctactcagggggctgaggcaggagaatcatgaggtcaggagatcaagaccatcctagctaacatggtgaaacccagtctctaataaaaatacaaaaaagccgggcgtggtggcaggtgcctgtagtcccagctactcaggaggctgaggcaggagaatcacaaggtcaggagatcaagaccatcctggctaacatggtgaaacccagtctctaataaagatacaaaaaagccaggcgtggtggcgggtgcctgtagtcccatctactcaggaggctgagtcaggagaatggcgtgaacctgggaggcgaagcttgaagtgagccgagatcgctgccactgcactcacaacctgggtgacagggtgagactccgtctcaaaaaaaaaaaaaaaaaaagaattttcaacccaaaatttaacatgtaggcaagctaagcttcataacctaaggagaaataaaatcctttatagacaagcaaatgctgagggattttgtcaccaccaggcctgccttacaagagctcctgaaggaagcactacatatggaaaggaaaaactggtaccagccactgcaaaaacatttgaaattgtaaagaccatcgatgctatgaagaaactgcatcaactaatgggcaaaataaccagctagcatcataataacaggatcaaattcacacataacaattttaaccttaaatgtaaacaggctaaatgtcccaattaaaagacacagactggcaaattggataaagagtcaagatccatcagtgtgctgtattcaggagacccatctcacgtgcaaatacacacataggctcaaaataaaggaatggagaaatatttaccaagcaaatggaaagcaaaaaaaagcaggggttacaatcctagtctctgactttaaaccaactaagataaaaaaaggcaaagaagggtactacataatggtaaagggatcaatgcaacaagaagacctaactatcctgaatatatatgcaaccaatacaggagcacccagattcataaagcaagttcttagagacctacagaaacacttagactcccacacaataatagtgggagacttgaacaccccactgtcaatattagacagatcaacgagacagaaaattaacaaggatattcaggacttgaactcagctctggaccaagcggacctaatagacatctacagaactctccagcccaaatgaacagaatatacattcttctcagcaccacatagcacttattctaaaattgactacataattaattggaagtaaaacactcctcagcaaatgcaaaagagtgaaaatcataacaaacagtctctcagaccacagtgcaatcaaattagaactcaggattaagaaactcattcaaaactgcacaactacatggaaactgctcctgaatgactactgggtaaataacgaaattaaggcagaaataaataagttctttgaaaccaatgagaacaaagtcacaacgtaccagaatctctgggacacagctaaagcagtgttcagagggaaatttatagcactaaatgcccacatcagaaagtgggaaagatctaaattcagcaccccaacatcacaattgaaagaactagagaagcaattatgtcacaattaaaagaactagagaagcaagagcaaacaaattcaaaagctagcagaagacaagaaataactaagatcagagcaaaactgaaggaggtagagacacgaaaaacccttcaaaaaatcagtgaatcgaggagctcatttttgaaaagatgaataaaatagactgctagccagactaatgaagaagaaaagagagaagaatcacatagacacaataaaaaatgataaaggggatatcaccactgatcccacagaaatacatactactatcagagaatactataaatacttctacagaaacaaactagaaaatctagaagaaatggataaatacctagactcatacaccctcccaagactaaaccaggaagaagtcgaatacctgaatagaccaataacaagttttgaaattgaggcagtaattaatagcctaccaacccaaaaaagcccagtaccaggcggattcacagccagattctaccagaggtacaaagaggagctggtactattccttctgaaactattacaaaccatagaaaaagaggggctccccccaactcattttatgaggccagcatcattctgctatcaaaacctggcagagacaacaagaaaagaaaatttcaggccaatatctctgatgaacatcgatgagaaaatcctccataaaatactggcaaactgaatccagaagcacatcaaaaagcctgtccaccacgatcaagttggcttcatccctgggatgcaaggctggttcaacatatgcaaatcaataaacgtaatccatcacttaaacagaaccaatgacaaaaaccacttgattatcccaatagatgcagaaaaggccttcaataaaattcaataccctttcatgctaaaaactctcaataaactaggtattgatggaacatatctcaaaataataagagctatttatgacaaacccacagccgatatcatactgaatgggcaaaagctggaagcattccccttgaaaactggcacaagacaaggatgccctctctcaccactcctagtcaacatagtattggaagttctggccaggacaatcaggctagagaaagaaataatgggtacaaataggaagggaggaagtcaaattgtttctgtctgcagatgacatgattgtatatttggaaaaccccattgtctcacccaaaatctccttaaactgataagcaactttagcaaagtctcaggatacaaaatcaatatgaaaaattcacaagcattgctatacaccagtaatagacaagcagagagccaaatcatgagtgaactcccattcacaattgctacaaagagaataaaatacctaggaatacaacttacaagggatgtgaaacatctcttcaaggagaactacaaaccactgctcaaggaaataagagaggacagaaacaaatggaaaaacattccatgttcatggataggaagaatcaatattgtgaaaatggccatactgctcaaagtaatttatagattcaattctatccccatcaagctaccattgactttcttcacagaattagaaaaaactattttaaatttcatatggaaccaaaaaagagcccatatagacaagacaatcctaagcaaaaagaacaaagctggaggcatcacactacctgacttcaaactagactacaaggctacagtaaccaaaacagcatgatactggtaccaaaaacagatatatagaccaatggaacagaacagagacctcagaaataatcccacacatctacaaccatctgatctttgacaaacctgacaaaaacaagcaatggggaaattattcctcatgtaataaatggtgttgggaaaactggctagccatatgcagaaaactgatactggaccccttccttacaccttatacaaaaattaagatggattaaaggcttaaacgtaagacctaaaaccataaaaaccctagaagaaaacctaggtgatagcattcaggacatagggatgggcaaagacttcatgactaaaacaccaaaagcaatggcaacaaaagccagaattgacaaatgggatttgattaaactaaagagcttctgcacagcaaaagaaactatcatcagagtgaacaggcaacctacagaatgtgagaaaatttttgcaatctgtccatctgccaaaggtctaatatccagaatctacaaagaacttaaacaaatttataagaaaaaaaaaaaccacatcaaaaagtgggtgaaggatatgaacaggcacttttggaatgaagacatttatatggccaacaaacgtgaaaaaaagctcatcatcagtagtcattagagaagtgcaaatcaaaaccacaattaggtactatgtcacaccatttagaatggtgatcattaaacagtcaggaaacagatgctggagaggatgtggagaaataggaactgttttacactgttggtgggtgtgtaaattagttcaaccattgtggaagacagtgtggcgatttcctcaaggatctataaccgacataccatttgacccagtaatcccattactgggtatacacccaaaggattatgaatcattctactataaagacacatacacacgtatgtttattgcagcagtgttcacaatagcaaagacttggaagtaacccaaatgcccatcaatgatagactggataaagaaaatgtggcacatatataccacggaatactatgcagccataaaggatgaattcgtgtcctttgcagggacatgagtgaagctggaaaccgtcattctcagcaaactaacacaggaacagaaaaccaaacactgcatgttctcacttataagtgggagttgaacaatgagaaaacatggacacggggaggggaacatcacacactgggtggggggctaggggagggataacattaggagaaatacctaatgtagatgatgggttgatgggtgcagcacaccaccgtttcacatgtatacctatgtaacaaacctgcacattctgcacatatatcccagaacttaaggtataataataatttttaaaaagtataagtcacgttgtacaagcaatcaccaggactctttccgtcttgcaaactgaaactctatacctgtttaaaaaaactcccatttcctcctcctcccagcccctagcaaccaccattctactttccgtttctatggatttgactactctaggtatttcacaggtaagtggaatcatacagtattgatctttcgtaactggcttatttcacttagcatgatatagttaaggttcttccatgttgtagtatgtgtttgcattttctttctttttaagactgaacaattttccattgtgtgtatagaccgcgttttccttatccattcctttatctatgtacgcctggattttctccgcctctcagctgttgtgtgtgtagtgctgctgagaacatgggtgtgggcttcattacttaacagtggctaccttaccaccatctaaagcagatttcatgctcaatctaagtgactttatacaactgagaaaatttactgggcctttgttcaagcttttttcaattttgcttcttactgtctggggtctagaagcaattttttttccctaacacttcaaaacctcaaatttctgagatgtcttcattgcttttcatttctctttgaagattggtcagttttttcctgtgctcaccacgtgcctgcaatgctttgccgaaggaagtttttcttgttcgtgtcagtctgatgtggattgagggtggtgtgctctgctccgacaatgattccgggcccaagctccttctctcatgtggctctctgactccagggctttatcctcttctgtactccactagtaaagagagagaaaaagattgcacaggaaggcttttaggggccagacctaaaagtggtttatgttcttctatctttacttcattgtccagacttggtatcatagccctacttcactgtaatgggaataggaaatacaatcttgctctattcccaggatggaaagaaaacaaggttaggtgaacatatagcacctggtgccacaggctggagataaatttggaagtaccagcatataggtggtgatcaaagccataagtaaagatgaggatcatcccgtaaagggagtaatgggagaccttcacaaaaacaagggcactttcttaagggtctttactggtaaaaataactttacaatgttaggttacacaagttattagtagaacagttactactgtgtttgtaggacgtttaaatgtgtgcattaaataaatgtaaaagtagttttttcagaaattggaatgtctttacttcttgaagtttaatacaaaagaaatatgtatcagcatccttttatgacaaagcctgtaaatgtaaaataatgctgaagttcagaaatactgaactaagtaaagatttatttttatttgtcgtttaaattatgtacatttattaagcatttactatgtaccaggcagtgtgaggattataacaataaatcacaatctctcaaggaagaccacatttagtaggacaaaaataggctgggcaaggtggctcacacttgtaatcccagccctttgggaggccaaggcgggaggattcttggggccaggagttcaagaccagcctgggcaacatagcaagattccatctccacaaaaaattttctgaaaatcagctgggcatggtgatgtacacctgtaatgctagctacttgataggcagagacagaaggatcacttgagcccaggagtttgaggttgtagtgagctgtaattgctccactgcactacagcctggggaacagagtgagaccatgtcttttaaaaaaaataagtaaggcaaataagttgatgccgaaaatcccaggcagaatcggcagtctggaagtaaaagcgcattgattttggagcccagcagatctaggtttgaatctcagctctgctcctctcagtgtaaccttggggaagttaatattcctgaacttctagtttccttatttctaagtttgtgataatagcacctacccttcaggttgctgtgattagggatgatctttgtaaacctaatgcagtgcttgcttgatattaaaaatgtagttatttttattaatattgttgaaggtagagttcatatgggatagaaaaatgagttaccttacagtctatgaattcattcatttagtatttagtgagccactactacgcactgtatacttaggattagattgtatgtatgtatttgtgtttgttttctaaagccccatttagtttttttaaaaaatgtttgtatcacaggtctgtacccaccaggtttacatatggtcttccccactttcaaatgcccagagaccaccctgtctgtcctggcactgtcttcatcctccctctttgctacagggatctgcctgacttatctctcataatctcctcttcctctgcccactcccgtattttccttgctcctatttctgctgacttcacctcagacagccttttttctttgcatacaaatttttgttagttctccccacccccaactttttttttttttttttttttgagatggtctcttgctttgtgagtgcaatggcacaagctcggctcactgcagcctccaccgcccaggctcaagtgattctcccaactcagcctcccaagcagctggaaccacaggtgtgtaccaccgtgccggctattttttgtatttttagtagggatggggtttcaccatgttgactaggctggtttcaaactcctgagctctggcgatccaccagcatgattcttaagcttaagcttttctaatggaaaaattaattcccccagttaccttaggcataatttaccaccttctttctgtgttcatttttcttctcatacattggaaaactctccaattatatcccctatagatctccaggtgtccccaccgaagtttctccctgctgatactaatgctgatactgacaccagcactccttgcacacttacgatctggcaggcactctgctccacctcttctttccccagcagttctgttgtaaactaattggcagcagagatcagatatgtacctttttggattctcagtacagctttttgcacaaaggaaatggtctataaatattggttggtcagagagaggatgaatgaacaattcatttgacctagcattaaaaataattttataaaaattatgtcatatgcaattgtattttgtttcattgccagtgttgtggacatttttaaataagaaatacaaatagtccgtcttcagtgtgggttaaatgtgcttttgtgggttacttaggaaccgcttattacattgttctatggcaaattatattccaagttctaaacaactgtctttacaaaagccattttgacacataaattataagatgtggactgtccagaatttttccttgtcactaattttttaaaagggaatttagtttttggtaaaaatgccttgtttatctttctcttatttatttaatcagtgtcttcttgtgccacttgccacaaataaagattctcaaacattttcagcctcagggaatgaagtagctgctagctagaaatagatcagggattaacaaatgtaatacatgttgctgatgtcatagggctgtgacttgggaggcagacatcccactataactaaaaatgggcatcaagtgcacagcatacaaatttacagattcaaatttttacatttgttattgccaatgaatatgtcacattattttgagaactagcccatcattaattagtttaaaaacaatatctaagttatgtcacatccatccctatcctgccacgctccatttaggactaccttgtccctctactggaccattgtactagagcccctaccctgcatcctgtccacagtcctttcctgtccaacccactcaccaacccagtcctcatcagacttcccttcacaatggctcctcaaaaactcaatgccaaatcaatcatattttctgatttcctttccctccctctttctctcttttttgtttctttcgtgtttagaaaaaaaatcaaaacaaaatgagtgaatacacagaaagtttttgcctcaaccactcactattctccagagtcatcctcactctctaccctcaccccctctgcaaatgcctgtctttctccacctaaaaatgtccagaggtcttgaaaggttcagttcaaaagctgcttcacagtgtttgcttctgtgttcatcttttctatccacatagatgaatatacatcatccctatttcccctgggaactttattcttttagaacttaaccatattctgccttgtgttacattatagctagtagattgcaagccccttaagaagagtttggtttaattttggatacttcttagcacttagcaaaggggtctcctcatagcaggggcataaaaagtgtttattgaacggttacttctctttaagatagaatagtttcagtatactttgttggaagttgatgtttgtgatatctccttctgtcattctacattttctttcataggagttcgtagattttcaaggtgcaagagcagccccattttattaacagctgtaatcttgcattttatctgaacctcacaatcagtgaattgtactgtctctcctggcagcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggtacgtgaagacaaacaaagcattcaaaataacagagagattagctgtaactaaaagaaattccctttcaagaaaattaaataaatacccaagataggctatgtagtaccaggcaatagagaaaagcttagacagaaagcagtgagaggagccacttacggggcctcagaatactgagttgaaggaaaagggcctttctctacctgccactaatgagactaaagttgttataaatatgtgccttatgatgaaaggggacaaccttatgatacagaattaacgctcacctcttgcatataaaaccagaatgaattgtgaaacaaatctctaaatgtaggcttctctttaaatcagatttactcaggccgggcgtggtggctcacgcctgtaatcccagcactttgggaggctgagacaggtggatcacctgaggtcaggagttcaagaccagcctagccagcatgatgaaaccccatcgctactaaaattcaaaaatcagctgggcgtggtggtgcacacctgtaatcccagctgctgcagaggctgaggcaggagaattgcttgatcccaggaggtagaggttgcagtgaacagagatcgtgctactgcgctccagcctgggtgacagagtgagactccatctcaaaaaaaaaaaaatagatgtatttgaatattattgattactgggcagaccagaattattctgaataatttttaataaaggcaggaagcttacctttattaagcttagatcataagatgctgattgtatgctatgcagacaagtctagatttcaataaccacaaaacatgaaggttatcttttaacaaatgagtaccagaactttataaaaatccttaaaatgagatgtttgcctgtcctaagaacttactgacccaacacctgatacatacaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaaggtctatttcattcagcgaatgatgcttgtattgaatgctgcgtgtgtgcaaggcatggggcttggcaccatggattcaaagttgaatgagaataactcccactctaaggtgctcatagtcacttaaaaataaaggctctgagccagaagatctctgctcctctgaggacagattatgagtattgactggaatgtggtgtcattaagaaagaggaatctttgtgccatctcgggacctcctagaacttaatataccattcacttagaaagccttacttctgatattttgtttctcagtggtagctctgttagcattttgagtaggacagtttcttgtttggaattgtttcccatatagcatcactagttcttgctcattaattgccagttgcagtccacccctgtcattatagcaaccaacttgacaatgccatgccctgccccattacatatatacatatagctaacatgtatcttaattcttttcttctaacattggcttttacattttagcttttgtttaaatctaaaaaaagaattcacatgaactgaataataaaataaaataatacaagcttaataaaaaatactgtaaaacaaatggactttcttttttcaaggatttatagctaatattagggcaagaaatactcagaatttagaattgcttgtttggtagctttgaaaagctcatagatcataaagaggagtgccagaaatgaaaaatgagttttaattttgtgtagttttataaaagactagaaaatgaggactaaagttgctgaatattaaatgtatgtttatatagcccgtttttttgctagagcccagagtactttttcatataaatatacaagattgtgtgggctacacagaaggattaggctcattatagaaacatccttaaagctagttgaatgttgacttttgtgcttgttctagtaaaattatgttgttattaatagctcattcataaaatacaaatggtgaggaggaggaagttagagaattacatttctcacctcaaatattcctaaaaaacaaatgtgttttgttttcttagctcatgctcgcctgatgtttcgtgatactgtaactctggaagacgctattacggtggtgtcagtcatggagtcctcaatgcaggtaaggatattttgtgtacctaatttttatcctaattacaaactttcttttttttaaaaaaggacactttattaacatatcaaaagttattaaaatgctcatattctagacttagtaattcctggaaatatatccaaaggtaaccgattaaatgaagaggaaacagtgtcctggagatatttgctgcatgggtggcattgcttttgcctattgatgtaaagtagtgcgcttcgatcgtttttttcctcaacacacctgagagatgttcatagcccaccagtgacagtatagcttcctagagcaatgattgccaccaagaactgggggagtgaactatagaaagttgaaaaagcctcccaagtgattttcatacccagtataggggtgtaaacggcggtcttagcccccggggattgctggtccctagagtgtacttaccgctatgcaggctggcctggtgactctcctggtattttctcaccccttcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggtgaggaatgaaaacccagaaaggcatacaatggaaaatccttgtttggcatttagtgaaacaaagcaagtgtgcattaagtggaaaaatctatctatcaggtgttgggtcagtaagttcttaggacaggcagatactatctataggagactgtttcagttttctactgctgtataatcaactgctccaaaactcagtgactgcgaacaccacccccaccagcattttagtgttcacttttctgggtatcagacattcaggcaggctcggtggggatagcttgtctttgctccacattgtgttggctgagataacaactcagcaatgacagaagcaacatttcaaaacttacctttctaatgactcattaaaatgtgaataatagacaaggaggatacatgggaagaaacatgtcacatgccttagtgtgaatgtggactctaccaaaaaaattttgcccaaactattaatgttcgcatactcccgaaatatgtggacttctaaaaacctaggttttgcgtgtaagcctgagaaataggagtgaggaatggcaagtttatccatttttggtgtcttcatgatcagtgtgaatggcttaataattgacctgcagctcttactggtgttggtctcaaagccggggtctggtgaatgaagtacatgaaaaagtggaacagctgcaaagaatttggggaccacattgagactgttgactacgttaaaaaaaaatccttgagaattcttccttctcacagcatccttctctttctagtttttgaaacttcagcacagccttcctggggaagtgcggggatgggcattatcctgttaatagccaggtgccagactgcagtaaacttgcactttgtataaaattcgcccctctttcttttggtctcctggctcattttatgatccagaacatggtgccaagatcaaagttattcctttgggttgtttatgatttgatgtagctgattcttttcaagccgctcctgggcttggctttgcttttggagaggctgctcattttgactgatccaagctaccagaaactgacatatgctggattcgggaaaggagaaaaagtgaggcccagaatcattgttatgaattagaaagatggcaattagacttcccaaatttaaaatgaccctcctggagggaaagaaaggaaaaacgaaagagtatttgacaatctaaaagacaggattctaccttaaaatgtttttttctactggtatttatttataatgtagaggcatgttctggtgttgatcctcctgaaagcaacaaaaccaggtactatgcaaatgaaagtgaattacctccaaggcacaatctaatgctaatcttatcaagtgagaaaaaacccaaccagcatatgagtttttactgttttggaaagagttctctgttccttaaggagataattataatgaaaccatttatagttttatcatgctttacttccagaaaatgctttatactggtgacagtctgactcggccattctatgtgcctcaaaacagagtgcaggcggggcacggtggctcacacctgtaatcccagcactttgtgaggccaaggtgggcagatcacttgaggtcaggagttcaagaccagcctggccaacatggtgaaacactgtctctactaaaaatacaaaaattagctgggtgtgttggcgggcgcctgtaattccagctactcgggaggctgaggcaggagaattgcctgaacccaagaggtggaggttgcagtgagccaagattgagtgaaactccatctgaaaaaaaaagaaagactaaaataatagggcttagtctaccctaacttattctcatcttttaggagatttttgcagaactttaacaattatcagtatccctgacctcaatttgatgctgaaaagtatgctaggtagtagtaattttgaaagctatttgcttttttgtttggttgtaactcaaattagtaaaaatgaacatgggtttgccccggggggcagaggtttcagtgagccgtgatcgtgccactgcactccagcctgggtgacagagagagactctgtctaaaaaaaaaaaaaaaaaaaaaaaaaaaaaaaaaaaggtgggtttgcttattgatattttcaaacctactgtgaatgaatgtaacccaatatgtttacaataattttgggggctttttttctgattataaaggtaatgcatgtttttattttgtatttttaaaagtagcagtgatgaattaattagaaaacaaaaaaatcacatgtagtcttatttcccagagatatataccattaacattttaatgtatttaaatatatttaaatataaggtatttccttatattttctatgattatacatgaattttagaataacttactcatctgctttctggtataatatcttttcaaagtaagcacgtagaagagggatcatattgtactttataagaaaaaggcatttctaggttgtcaggaaaggctttctaaaggacctacttctagggaactacaatccttattaggaagtcatcctccctcatgaccaaagggaaatttgaaatgaaaatatgagatctggcaagatggccaaataggaacagctgtggtctgcagctcccagcaagaccaatgcagaaggcaggtgatttctgcgtttccagctgaggtacccagttcatcgcattgggactactggttaggcagtgggtgcagcccacagaaggtgagcagaagcagggtggggcatcacctcaccctggacttacaaggacccggaggacttccctcccccagccaaggaaagcagtgagggactgtgctacctggcctggatactacgcttttcccatggtttttgcaatccacggatcagaagattccctcatgagcctacaccaccagggccctgggtttcaagcacaaaactgggtggcaatttgggcagacactgagctagcttcaggagttttttttcataccccagtggcacctggaaccccagcgagacagaaccattcactcccctggaaagggggctgatggcagggagctgaatggtctcagtgggtcccactcccatggagtctagcaagccaagaaccactggcttgaaattcttgctgccagcacaccattctgaagtcgacttgggatgatcgagcttgtagggggaggagtgtcccccgttactgaggcttgagtaggcggttttcctctgacagtgctaaggaggccaggaggtttggactgggtggaatccaccacagtgtggcgaattggctgtggccagataccttctctagattcctcttcactgggcagggcatctctgaaagaaaggagccccagtcaggggcttgcagataaaactccctgggacagagcacctgggggaaggggaagctgtgggtgttgcttcagcagactaaaactttcctgcctgccagctctgaagagagcagctgatcctaactaggaggattctagcagcacactctgctaagggacagactgcttcctcaggttggtccctgacccctgtgcctcctgactgagagagaccacccagcagggttcagcagacacttcatgtaggagagctctgctggcatcaggctggtgcccctctgggacaaagcttccagaggaaggagcaggcagcaatctttgctgttctgcaccctccactggtgataccccaggcaaacagggtctggagtggacctctagcaaactgcagcagacttgtggaagaggggcctattagaagaaaaactagcaaacagaaagcaaaaacaacaacatcaacaaaaagggcccccacacaaaaaccccatcctaaggtcatcagctcaaagatcaaaggtagataaatgcacgaagatgaggaaaaaccagcacaaaaatgctgaaaattccaaaaaccagaatgcctcttcaaatgattgcaactcctctccagcaagggcacaaaactggacagagaatgagattgacgaattgacagaagtaggcttcagaaggtgggtaataacaaactcctccaagctaaaggagcatgttctaacccaatgcaaggaagctaagaaccttgataaaagattacaggaactgctaactggaataaccagtttagaaagaagcgtaaattacctgatggagctgaaaaacacagcacgagaacttcatgaagcatacacaagtatcagtactcaaatcaatcaagcgtgagaaaggatatcagagattgaagatcaacttactgaaataaggcatgaagatgagattaggaaaagaaaaaagaatgaaaaggaatgaataaaacctccaagaaatatgggactgtgtgaaaagaccatacctaagattgattggtatacctgaaaatgatggggagaatggaaccaagttggaaaacacacttggatattttccaggagaacttccccaacttagcaagacaagccaacattcaaattcaggaaatacagagaacaccactaagatactcttcgagaagggcaactccaagacatatactcatctgattcaccaaggttgaaatgaaggaaaaaatgttaagggcagccagagagaaaggtcaggttacctacaaagggaagcccatcagactaaccgcagatctctcggcagaaaccctacaagccagaagacagtgggggccaatattcaaaattcttaaaaagaattttcaacccagaatttcacatccagccaaactaagcttcataagtgaaggagaaataaaatcctttacagacatgcaaatgctgaaatattttgtaaccagcaggcctgccttacaagagctcctgaaggaagcactaaatatggaaaggaaaaactggtaccagccactacaaaaacataccaaattgtaaagaccgttgatgctatgaagaaactgcatcaactaatgtgcaaattgaccagatagcatcatgataacaggatcaacttcatacataacaatattaaccttaaatgtaaatgggctaaatgctccaattaaaagacacagactggcaaattggataaagagtcaagacccatcagtgtgctgtattcaggagacccatctcacgagcaaatacacacataggctcaaaataaaggaatggaggaatatttaccaagcaaatggaaagcaaaaaaaaagcaggggttgcaatcctagtctctgatgaaacagactttaaaccaacaaagatcaaaaaagacaaagaagggtactacataatggtaaagggatcaatgcaacaagaagagctaactatcctaaatatatatgcacccaatacaggagcacccagattcataaaagaagtccttagagaccttcaaagaaacttagactcccacacaataatagtgggagactttaactccccactgtcagtattagatagatccatgaggcagaaaatttacaaggatattcaggacttgaactcagctgtagacaaagtggacctaatagacatctacagaactctctaccccaaatgaacagaatatacattcttctcagcaccacatagcacttattctaaaattgaccacagaattggaagtaaaacactcctcaggaaatgcaaaagattggaaatcatcacaaacagtttctcagaccacagtgcaatcaaattagaactcaggattaagaaactcactcaaaactgcacaactacatggaaactgaacagcctgctcccaaatgactactgggtaaataatgaaattaaggcagaaataaataagttctttgaaaccaatgaaaacaaagacaaaacataccagaatctctgggacacagctaaagcagtgttcagagggaaatttatagcactaaacgccctcaggagaaagagggaaagaactaaaattgacaccctaacatcacaattaaaagaactagagaagcaagaacaaacaaattcaaaagctagcagaagacaagaaataactaagatcagagcagaactgaaggagatagagacacgaaaaacccttcaaaaaatcagtgaatccaggagctggttttttgaaaagattaacaaaatagatagaccgctagccatactaatgaagcagaaaagagagaagaatcaaatagacacaataaaaaaatgataaaggggataccacaactgatcccacagaaatacaaactaccattagagaatactgtaaacaactctatgcagataagttagaaaatctagaagaaatggataaatttctggacacataaaccctcccaagactaaaccaggaagaagttgaatccctgaatataccaataacaagttctgaaagtgaggcagtaattaatagcctaccaaccaaaaaaagtccaggaccagacagattcacagccaaattctaccagaggtacaaagaggagctggtatcattccttctgaaactatttcaaacaatagaaaaagagggactccccactaagtcattttatgaggccagcatcatcctgattccaaaacctggcagagagacaataaaaaaagaaaatttcgggccagtatccctgatgaacattgatgtgaaaatcctcaataaaatactggcaaactgaatacagcagcacatcaaaaagcttatccaccatgttcaagtcagcttcatctctgggatgcaaggctggttcaacatacacaaatcaacaaacgtaatccatcacataaacagaaccagtgacaaaaaccacatgattatctcaatagatgcagaaaatgccttcaataaaattcaacaccccttcgtgctaaaaactctcaataagctaggtgttgatggaaagtatctcaaaataataagagctatttatgacaaacctacagccaatatcatactgaatgggcaaaagctggaagcattccccttgaaaactggcacaagacaaggatgccctctctcaccactcctagtcaacatagtattggaagttctggccagagcaatcaggcaagagaaagaaataaaggatattcatataggaagagaggaagctaaattgtctctgtttgcagatgacatgattgtatatttagaaaaccccatcatctcaccccaaaactccttaagctgataaacaacttcagcaaagtttcaagatacaaaatcaatgtgcaccaatcacaagcatttctatacaccaataatagagagctgaatcatcagtgaacttccattcacaattgctacaaagaaaataaaatacctaggaatacaacttacatgggatgtgaaagacctcttcaaggagaactacaaaccactgctcaaggaaataagagaggatacaaacaaatggaaaaacattccatgctcatggatagggtgaatcaatattgtgaaaatagctgtactgcttaaagtaatttatagattcaatgctattcccatcaagctaccgttgactttcttcacagaactaggaaaaactactttaaatttcatatggaaccaaaatagagccggtatagccatgataatcctaagcaaaaagaacaaagctggaggcatcacgctacctgacttcaaactatactgcaggctacagtaaccaaaacagcatggtgctggtaccaaaacagatatatagaccaatgaaacagaacagaggcctcagaaataacaccacacatctacaaccatctgatcttccacagacctcacaaaaataagcaagggggaaaggattccctatttaataaatgatgctgggaaaactggttagccatatgcagaaaacagaaactggacctgctccttacaccttatacaaaaattaactcaagttggattaaagacttgaattttaaacctaaaaccataaaaaccctagaagaaaacctaggcagtaccattcaggacataggcatgggcaaagacttcatgactaaaataccaaaagcaattgcaacaaaagctaaaattgacaaatgggatctaatcaaaccaaagagcttcagctcagccaaataaactatcatcagagtgaacaggcaacttatagaatgtgagaaaatttttacaatctatccatctgacaaagggctaatatccagaatctacaaggaacttaaaaaaatatacaagaaaaaaagccatcaaaactgggtgaaggatatgaacagacacttcccaaaagaagacattcatgcagccaacaaacatgaaaaaaagctcatcatcactggtcattaaagaaatgcaaatcaaaaccacaatgagataccatcttacaccagttagaatggtgatcattagaaagtcaggaaacaacagatggtggctaggctgtggagaaataggaatgcttctacgttgttggtgggagtgtaaattagttcagccattgtggaagacagtgtggcgattcctcaaggatctagaaccagaaataccatttgaaccagcaatcccattactgagtatacacccaaaggattataaatcattctactgtaaagacacatgcacacgtatgtttattgcagctctatttacaatagcaaagactgggaaccatcccaagtgcccatcaatgatacactggataaagaaaatgtggcacatatacaccatggagtactatgcagacataaaaaaggatgagttcatatcctttgcagggacatggatgaagctggaaaccatcattctcagcaaactaacacaggaacagaaaaccaaacaccacatgttctcactcataagtgggaattgaacaatgagaacacatggacacagggaggagaatgtcacacactggggccttttggggggtggggtacaaggggagggagagcattaggacaaatacctaatgcgtgtggggcttaaaacctaaatgatgggttgataggtgcagcaaaccaccatggcacatgtatacctatgtaacaaacctgcatgttctgcaaatgtatcccagaacttaaagtaaaaaaaaacaagaaagttgtccttctggcaatatttcagtttctaatatgcccaagatatttaaaatgatttaaaatcatttaaaatgattatcactgaacagatctttcattcgtagaaagtaaatagattttaattctgtatcaaattgataaaagagtagctgcccagtaaatatgtttaaacatgcctgggctttgcaggaaagattgtcacagttgcctggggaggtctgccatgaatgggagtacaggaggcggcagtgtgagcaccagtacagaagtatcacagactcttgactcctgaggaaggtgactgctcagatgcactcagtacctcaactgggtaaagagatgtgagacctcataatccccagtctttcactttggttccttgatctgcaaactgactactaagcaagttagccaacaacctacttggtcagcaatcagctactgtgtgggtagcaacaggtctgtcttgtatttgaacatttaacatgagagataaagctgaggattttacactgatcttcaaacaatcttaaatgaatgaattggacttttggagagatctaaaaatgtagacaaatctccgatttcattttctttattttactacaattttaggttaaattagtgtttatctgagtatgtaaattgtatattgatttaaaaaaggattatttcattctgctgctctaggaggttgtatttgatattaacttggaattatgtgggacttaaatctttaagatggtatctcagagactaaagaaatgaataggttagcacaaattctcttcccttcaagacatgttttatttatttgtctttgctacaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactgggatgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctactttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatatactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaa

SEQ ID NO: 39 - DNA, 15399 bp, Artificial Sequence
  Based on Homo sapiens sequence
ctgctggcctcaggcagtcttcctcccttggccacccaaagagatgggattgcaagcatgagccactgtgcacagctgagatttttcgacttagtctttttgtacacccagtatcttatagaatatccataatatagattcataaataaaccatttccttcaatagtataaataaataaaccactgctataaatggtggaatttctgagttaagagcaatacatatgatacaaaacttgatatatagagtttcttagccaaactggaggggctggctttaggtgatccgtggactccctgaaactggggacaccattggaaatatgtgtgagctcatgggcagtttccgatgatttccagtcctcaaaatatctcttggactcaaagatgccttagggcagaggacacgttacacccagtacagaatctcggacagtgaatatcagtaaacattcggcagaaaagctctgccaaattgagtgctctgatgtgactttttcatcaagtcaatgttcctgggatctcttgtacatgatactctcactcttataaggtttcatcgtttctgcttaccctagttttctttcccatcctgatccctctcccaccagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgtttttgttcaaactggttgccaggttggaatgacctatgacatcagagattccgaccttcctgattggaaggaccggactctgtcggcgcctggcagttcaggtgaacaacagtaacttctcagagctgttctccactcctgacttctcccagcctcgagaattgataacacactcttctggatcccagcagtgtccagaagaagaccaaggacagaacagagactagcttcggtgagattggacagattttgggaaagatcatgacgagccatcaaccgcagccccaggaagagcagagcccccagcggagcacctcagggtaccccctccaggaggtggtggatgatgaagtgtcgggaccatcaggtgaggggactggaggaagaagaggtggcataggattgactaagacgaaggaagggggccaggtgcggtagctcacccctgtaacaccaacactttgggaggccgaggcgggcagatcacctgaggtcagcagttcaagaccagcctggccaacatggtgaaaccccatctctactaaaagtacaaaaattagccaggcggtagtggtgtgtgcctataatcccagctactcgggaggctgagacaggagaatcgcttgagcctgggaggaagagggtgcagtgagccgagatcgtgctactgcactccagtctgggtgagagagtgagacgctgtctcaaaaaaaaaaaaaaaaaaagaagaagaaaaaaaagaagggtcagaggtcaggaaggagaacctggggagggtgtgtgggaagaatggagaaattcaggctgggtgcagtggctcacacctgtaatcccagcactttgggaagccaaggcaggcggatcacgtgaggccaagagtttgagaccagcctggccaacatggcgaaaccccgtctctactaaaagtacaaaattgagctgggcattatggcaggcacctgtaatcccagctacctgagaggctgaggcaggagaataactggaatccgggagatggatgttgcagtgagctgagattgtaccactacactccagcctgggtgacaaagcaagattctgtctcgaaacaaaaaaaaaaaaagagggcctcagagagccagggaccagggaacgatatgacgcagtgttctgaggacagagagagggaagaatggggaggggaaggagtggcacatggggttgagcagaggagaaagtcagaaaggtggcttggagaagccagcagtctgagaggctggggaggatggagaatggtttggggtttggggtcggggtctaacgtgatcagttgcagaagcattacacggtggcctggtttctttactcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaaaagaggaaacttccaataaccacacttttccaatgggaaaaatatgccccagtgggtgagctctccatgcgggaggactctgaagtgatcactcatgagggacacttaggagacaacagaggattaggtagacttgataaaggtcggtgcttgggataagaaagcttggttttgggccaggcgctgtggctcccgcctgagatcccagcacgttgggaggctgaggcaagaggattgcttgaactcaggacttcgaggctgcagtgagctatgactgcaccactgcactccagcctgagtgacagagcaaaactctgcgtcaaaagaaaaaccaaggctgggcacagtagctcatgcctgtagttccagctactcgggaggctgagacaggagaatcgcttgagcctgggaggaagagggtgcagtgagccgagatcgtgctactgcactccagtctgggtgagagagtgagacgctgtctcaaaaaaaaaaaaaaaaaagaagaaaaaaaagaagggtcagaggtcaggaaggagaacctggggagggtgtgtgggaagaatggagaaattcaggctgggtgcagtggctcacacctgtaatcccagcactttgggaagccaaggcaggtggatcacgtgaggccaggagtttgagaccagcctggccaacatggtgaaacccccgtctctactaaaagtacaaaattgagctgggcattatggcaggcacctgtaatcccagctacctgagaggctgaggcaggagaataactggaatccgggagatagatgttgcagtcagctgagattgcaccactacactccagcctgggtgacaaagcaagattctgtctcgaaacagaaaaaaaaaagagggcctcagagagccagggaccagggaacgatatgacgcagtgttctgaggacagagagagggaagaatggggaggggaaggagtggcacatggggttgagcagaggagaaagtcagaaaggtggcttggagaagccagcagtctgagaggctggggaggatggagagtggtttggggtttggggtcggggtctaacgtgatcagttgcagaagcattacacggtggcctggtttctttactcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaaaagaggaaacttccaataaccacacttttccaatgggaaaaatatgccccagtgggtgagctctccatgcgggaggactctgaagtgatcactcatgagggacacttaggagacaacagaggattaggtagacttgataaaggtcggtgcttgggataagaaagcttggttttgggccaggcgctgtggctcccgcctgagatcccagcacgttgggaggctgaggcaagaggattgcttgaactcaggactttgaggctgcagtgagctatgactgcaccactgcactccagcctgggtgacagagcaaaactctgcgtcaaaagaaaaaccaaggctgggcacagtagctcatgcctgtagttccagctactcgggaggctgagacaggagaatcgcttgagcctgggaggaagagggtgcagtgagccgagatcgtgctactgcactccagtctgggtgagagagtgagacgctgtctcaaaaaaaaaaaaaaaaaaagaagaagaaaaaaaagaagggtcagaggtcaggaaggagaacctggggagggtgtgtgggaagaatggagaaattcaggctgggtgcagtggctcacacctgtaatcccagcactttgggaagccaaggcaggcggatcacgtgaggccaggagtttgagaccagcctggccaacatggtgaaacccccgtctctactaaaagtacaaaattgagctgggcattatggcaggcacctgtaatcccagctacctgagaggctgaggcaggagaataactggaatccgggagatagatgttgcagtcagctgagattgcaccactacactccagcctgggtgacaaagcaagattctgtctcgaaacaaaaaaaaaaaagagggcctcagagagccagggaccagggaaggatatgacgcagtgttctgaggacagagagagggaagaatggggaggggaaggagtggcacatggggttgagcagaggagaaagtcagaaaggtggcttggagaagccagcagtctgagaggctggggaggatggagaatggtttggggtttggggtcggggtctaacgtgatcagttgcagaagcattacacggtggcctggtttctttactcagcccctggggtagatcccagccccccacgtaggtcccttggctgcaaaaggaagagggagtgtttggatgaatctgatgatgagccagagaaggagctcgcccctgagcctgaggagacctgggtggcagagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaaaagaggaaacttccaataaccacacttttccaatgggaaaaatatgccccagtgggtgagctctccatgcgggaggactctgaagtgatcactcatgagggacacttaggagtcaacagaggattaggtagacttgataaaggtcggtgcttgggataagaaagcttggttttgggccaggcgctgtggctcccgcctgagatcccagcacgttgggaggctgaggcaagaggattgcttgaactcaggactttgaggctgcagtgagctatgactgcaccactgcactccagcctgggtgacagagcaaaactctgcgtcaaaagaaaagccaaggctgggcacagtagctcatgcctgtagttccagctactcgggaggctgagacaggagaatcgcttgagcctgggaggaagagggtgcagtgagccaagatcgtgctactgcactccagtctgggtgagagagtgagacgctgtctcaaaaaaaaaaaaaaaaaaagaagaagagaaaaaagaagggtcagaggtcaggaaggagaacctggggagggtgtgtgggaagaatggagaaattcaggctgggtgcagtggctcacacctgtaatcccagcactttgggaagccaaggcaggcggatcacgtgaggccaggagtttgagaccagcctggccaacatggtgaaacccccgtctctactaaaagtacaaaattgagctgggcattatggcaggcacctgtaatcccagctacctgagaggctgaggcaggagaataactggaatccgggagatagatgttgcagtcagctgagattgcaccactacactccagcctgggtgacaaagcaagattctgtctcgaaacaaaaaaaaaaaagagggcctcagagagccagggaccagggaacgatatgtcgcagtgttctgaggacagagagagggaagaatggggaggggaaggagtggcacatggggttgagcagaggagaaagtcagaaaggtggcttggagaagccagcagtctgcgaggctggggaggatggagagtggtttggggtttggggtcggggtctaacgtgatcagttgcagaagcattacacggtggcctggtttctttactcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaaaagaggaaacttccaataaccacacttttccaatgggaataatatgccccagtgggtgagctctccatgcgggaggactctgaagtgatcactcatgagggacacttaggagacaacagaggattaggtagacttgataaaggtcggtgcttgggataagaaagcttggttttgggccaggcgctgtggctcccgcctgagatcccagcacgttgggaggctgaggcaagaggattgcttgaactcaggactttgaggctgcagtgagctatgactgcaccactgcactccagcctgggtgacagagcaaaactctgcgtcaaaagaaaaaccaaggctgggcacagtagctcatgcctgtagttccagctactcgggaggctgagacaggagaatcgcttgagcctgggaggaagagggtgcagtgagccgagatcgtgctactgcactccagtctgggtgagagagtgagacgctgtctcaaaaaaaaaaaaaaaaaaaaaagaagaagaaaaaaaagaagggtcagaggtcaggaaggagaacctggggagggtgtgtgggaagaatggagaaattcaggctgggtgcagtggctcacacctgtaatcccagcactttgggaagccaaggcaggcggatcacgtgaggccaggagtttgagaccagcctggccaacatggtgaaacccccgtctctactaaaagtacaaaattgagctgggcattatggcaggcacctgtaatcccagctacctgagaggctgaggcaggagaataactggaatccgggagatagatgttgcagtcagctgagattgcaccactacactccagcctgggtgacaaagcaagattctgtctcgaaacaaaaaaaaaaagagggcctcagagagccagggaccagggaacgatatgacgcagtgttctgaggacagagagagggaagaatggggaggggaaggagtggcacatggggttgagcagaggagaaagtcagaaaggtggcttggagaagccagcagtctgagaggctggggaggatggagagtggtttggggtttggggtcggggtctaacgtgatcagttgcagaagcattacacggtggcctggtttctttactcagcccctggggtagatcccagccccccgcgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaaaagaggaaacttccaataaccacacttttccaatgggaaaaatatgccccagtgggtgagctctccatgcgggaggactctgaagtgatcactcatgagggacacttaggagtcaacagaggattaggtagacttgataaaggtcggtgcttgggataagaaagcttggttttgggccaggcgctgtggctcccgcctgagatcccagcacgttgggaggctgaggcaagagaattgcttgaactcaggactttgaggctgcagtgagctatgactgcaccactgcactccagcctgggtgacagagcaaaactctgcgtcaaaagaaaaaccaaggctgggcacagtagctcatgcctgtagttccagctactcgggaggctgagacaggagaattgcttaaacccaggaggcagaggttgcagtgagccaagatcaggccaatgcattccagcctggcccacagagcaagactctgtctcaaaataaattaataaataaataaaaataaaaatcaaacaaagaaaaacaaaatcaaaaatcaaaaaagtggtttcagctgtgccctctgaaacttaatgtttcttactgacttttctaaacctaagtgtctccatccatagtgggggataccaaggccatggtcacaccctgatgtgtgactgtctcatgaggaaatgatgggaattcctttatgactctgcagtggtccctccgtgtctgctggagggggtcccggctgattcccagctctacatcctgtagattctcacacccagggcctccttcggcctcttctcaggggagtctcagagcaggagcctctctcccttgcccagtgaaagtcattctcccctctcccatccacctcacccgcggccacaatcctgagactttcccccgggaggcacacttctcctcactgccctgctgctcccatggaaaccctgtcctgcttctcacgctgacatctgctctctaatcacagaggatcctgtcattaaaagattcctggcctgggacaaagatctgagggtgtcagacaaggtaaggttgttctctatgtaactgtgttcctgttctaacgcacggccagggggagggcgcagcttccaaacccacagttctccctccaccacctcccaccagatgctcctacagttttttttgtttttgtttttgtttttttttgtgagacacagtcttgctctgttgcccaggctggagggcagtgtctcgatcttgactcactgcagctgatgcctcctgggttcaagcgattctcctgcctcagcctccaagcagctgggattacaaacgtgaaccaccacgcctggctaatttttgtgtttttagtagagacggggttttgccatgttggccagattggtcccgaacacctgacctcaggtgatccacccgccttggcctcccaaagtgctgagattacagacgtcagcactgtgtccgaccagctcccatggtcttgagtcttggcacccacacatttttttttctgagacagagtccagctctgctccccaggatggagtacagtggcatgatcatagctcactctaattcctgggctcaagcaatcctctttccttagcctcctgaggagctgggactaggcacatgccaccatgctcaacgaatttttgaaatcttcgtagaaacagggtctcgctgtgttgcccaggttgttctccaactgttgggctcatgtgatcctcctgtctccacctctcaaaaagtactgggatcacaggcttgagccgccactcccggctattctttgtctttttatgatttgtcagcatctccctcaggactctgctggtctcttgcagagtgaatgagtggcccctgcctctcccatgggtcctttgggatctgagccctaggccaccgtctggctgcagtcctgaagctcctgggccctctactctcagctccttgggacagttctctgcctggcacacaaaagaccctcctgacaccagccgacctagacacaccccctccaaagatcccatcggagcccaccatcctgggagcatcacctaaaacccttcctccggcttctcggatttgcatccgaccttcgaatacccctccaccccgcaatttccacatgagcacagtcaccccaatgctgaggtcccttctctgatgggcaacccctccccagacccccattccactatctccacaatcttcctctcccaagatgtgacctctccctctctgtgttcctttctctccatcagtatctcctggctatggtcatagcgtatttcagccgggccggcctcccctcctggcaataccaacgcattcatttcttcctggctctgtgagtggtttgctgcctcctatccatcaatatccaacgccctgggacagcgggggaagtgggattccagcctttcatttattctttcacctatttgtcctctttactctgtgtacaaaaaagacaggattatagtatcttagactgttgtctctaaaaagaaactcaggctgggcatggtggctcaggcctgtaatcccagcactttgggaggccgaggcaagcggatcacctgaggtcaggagtttgagaccagcctggccaacatggcaaaccccgtctctactaaaaatagaaaaatcagtcgggcatgttggtgtgcacctgttatccaagctacttgggaggctgaggcatgagaaccccttgaacccaggaggtggaggttgcagtaagctaaggttgagccactgcactccagcctgggcaacagagtgagactttttctaaaaacaaaagagccaaaaaaaaaaaaacaggcaaaaaaaccaaactccaatgccagtgtacaaataaaagagtaaaacaggccaggtgcggtggctcacgcctgtaatctcaacagtttgggaggccgaggtgggcagatcacaaggtcaggagagcaaaaccatcctggctaacatggtgaaaccctgtctccacttaaaaaaaaaaaaaaatacaaaaaattagccaggtgtggtggcgggcacctgtagtcccagctactcgggaggctgagggaggagaatggcgtgaacctgggaggcggagcttgcagtgagccgagattgcaccactgcactccagcctgggcgacagaatgagactccgtctcaaaaaaaaaaaaaaaaaaaaagaacaaaaaacaaaaggaaccatgaaccgctcctaaggggagaacaaaaggagcggaggagcggacatgacacttcccccagcaagcagacgtttccggttcttctctctctctccttcccacatcaaccgcaaaagccaccaacctcctctgggttcccgtgacagaggtcacagtccaggtcccccttgcatcacttgaatccactgtcaaatgctccctgctggggtctcctggagtctctccccaagccaaggggcttcctagtgcagcctgaacatctttccaaagcacgacaacctcactgcccacctgaacaacttccttagctgatgtctttctctatcgaggccagggtccacagtgccaattccaccctctctacaatctctacaaccacactggctcgccatcttggtgtttcctggcttggcttcactgctccttccaaatgccctccacttgactttgcattcgtgttttctgtctgggtgtcccacacacatgtggttctgaagggaagcacccattccttgaagtcggttcaccccacagcctctgtgatgccttccctcatcttccaacttctgcatgcccgtagctctccagttacatcctcttataatgtgacattgggattaggtcatctcccctgattactcccagtcccattagactagatgcctgtagaaggcagggtcctggcaaaatatcaatgtattcaattgctttttttttttttttgagacagacttgccctgtcccctaagctggagtgcagtggtgagatcatagctcaccgcagcctccatatcctgggctcaagcgatcctcccacctcagcctcttgattagctccgactacagggctgtgccaccacacctggacagttatttatttatttatttatttatttatttatttatttatcaagacaagagtgttgctgtgtctctcaggctggaatggaggggcccaatcttggctcactgcaacctccgcctcctgggttcacacaattcttatgcttcagcctcttgagtagctaggactaatgggtgtgccaccgcaccaggctgatttttgtatttttagcataaatggggtttctctgtgttggccaggctggtctcaaactcctggtctcaagcaatccacctgcttcagccttccaaagtgctgggattacaggcatgagccaccacgtctggcgtattttttatatttttaatagagacaagggtcttgctatgttgcccaggcctgtctcaaactcctggcctcaagtgatcctcctgcttcggcctcccagtgtgctgggattccaggcctaagccaccactcttggtcaccagttgggtttttgtctccatcctgaaggagtgggagatgcccttgatcaggtctctgtccagcagagccctcctgaggaaggcgtggctctctgcagggtgggtgccagtcctgagctagggacggtcccttaccttcctctctgggaagctgacctcagccggaggtctctcctggtggtgcccctgagcagcaacctgatttctgtcctcagctatctggccaatgacatggaggaggacgacgaggcccccaaacaaaagatcttctacttcctgtacgggaagacccactctcacatacccttgcgccctaagcattggttccagttatgccgtcccatgaacccgagggccaggaagaactgctctcagatagccttgttccagaagcgtcggttccagttcttctgttccatgcgctgcagggcttgggtttccccggaggagttggaggaggtgggtggggcctggggaggtggaggatgtggggaggaatcgggtgggctggaggctggacgaggggagagaggggtatcctggggagtccccgtcttctcaaagcgcatttgtttttccagatccaggcttatgacccagagcactgggtgtgggcgcgagatcgcgcccacctttcctagagctccagggaccgtggaggcctgaggtcatcggcctgagagaaggtacatctgcatcctccggggtaaaggcagaatattggggtctatttcggaaatccaaggaacccaattgcttgatctggcttcaagcctcggcaacgtggcgagatatcccctctccacaaaaatacaaaaattagccaggcgatgtgggaggcatctctactcccaactactcaagaggctgaggcaggaggatcgctggagcctgggaggtcggggctgcagggagccctgatcctgccactgcactccagccggggcgacagagtgagaccctgcctcaaaaataatcataaatactgagttcggggaggttctttatgattgatgcacttgagttaccgatttgggtcgagggttcagtgaagctttggtttacatcttgtgcagctaaccatgttgagcacagagcatgagacttcgtcatgaggaggtaggattatggattaggcttctggactcgtggtttgtgatgttgtcacattagaaacagatctagcacagttacaagtttagatctgaagtgacacaaaagaccctagctgtgatgaagtccaaagccacattctctgagggtgccctactccctgggaagacccacccaaagtcctcgctatgaagcagatcactggggctgaccttgggtgtattaagttttggagtcagggtcaccaaagcgtgagtttcacagttgaacacgatggttcagaagcagggtatagaatgaaaggcaggagataaaatcgcacttctcaattgctctgaactctagctagacttgacatgggacgtgaataaccttcctgtctagagagctgtctccttgaggtgtgacattgtctctctcacttccagaacaccggacccaggggagatgtggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttacggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaatcattaataggtttatttcaaatagtttggaaattgttgtacttttgaaaacatgctgttcctgtagagttttttgatgagagttatagttgttatatatacataaagataattttcttttcatttttaagtgagaattctttttatcctaaatcttttattatctttaaatttttctctgtattattatatgtgctcctgaagcgagcactctttttatctatgatacttccataataatctcttctatttatagctattggtagttcccccaaattctggtcatagaaatttttatttgctgtttaggtttgtgactgaattgtgagaattcagttgtgatttttaacatgtcttagatatatatactaacatgtctaatatatactatctattttattgatttatttcgaaaaagatgggcaaagaattatttaaatattattttatttatttaaatatttattaaatatatttatttatttaaatatttattaaatatatttatttatttaaatgttattactttaaatattattttaaatattttggaaatactggtatttttgaatagatgctgtttctataaagctgtgtgatgggtattataactgttatatacacataaatataattttgttttcctttttaagagaggattctttttatcctaaatcttttacctttcaatctttgtatctattactacatatgctgctgaagggagcagactttttatctatgatacttagttaatgtatatattacatttatagctatgtggtagttcccctaaattcttgtaaaaataaatttttatttgatattta

SEQ ID NO: 40 - DNA, 5931 bp, Artificial Sequence
  Based on Homo sapiens sequence
gtacaggtggtctcttgggttccggtaaggcggcggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggtgtgggcctcggggggccgggctggtggggagggcctgggcacggtgtgggaggggactgcgggctggggctgagccgcgagggaccgccctggggttcagggtgtcaccttgggaaccgctgaggctgagaggagtccaaaaagccactttgaggcggccgggaagctgcagggttgagagggaaagagaaactaactgggagggctgccttctgtcctctaaggatgtcgaaaaagaaatgggcccaagagaaaaataaataaaccagtttctgaacgtttcatttcgttacgtgaggaccgccccgaagtagatccatggcctctgaattgtttttcctgtgtcagaagtgaatttgcaccaagctgtgtcttcagaacccctgagcactgggggaagttgctagctaaggacctcatatcagtcctttaaaaaaagttctccttcccccggcctctgccccttttctgctggggtaaggagctcgctgccaccagtaaactcagcaccatccttaacgggactgtggcctgatttccaagtagaatacattttggaacccagtggtcatgctccatacagagacaggaataaaaataacacccagcattattgaagatctgtatgccaggagctgtgccaagcatttcagattttcctttttgtcttaaatgaaaatgaagtgtccttgcctataactgtcattgaagctacacagtaaccctgtggagtaggcattattatcatccctgttttacaacgcgaggaaactgaggcataggaaggctaagaaacttgcttgtggtctgtctccagaacacttgcttttaacccttgttctttcctcctgctgcctggcagtgaggtgtgaggatttctttgtgcaaatggtaagtaattccacataagtggatgttctccgttgagattgaggtagaagagtttcttgcagggataactggcattcagagggcatttgttcagaagagtgaaatttaaaattagctgggacaagaaaggtgcctatatgacgtagagtctcttgagtctagagaagaggttcccaaattttctcagtaattttttcatgatgcccttaggccagaaatatttcccagttcatttatttagaaagtttattttgccaaggttaaggatgcacccgtggcagaacctcaggcggtcctgaggacatgtgcccaaggtggtcggggcacagcttggttttatacattttagggagacatgagacatcaatcacatatgtaaggtatacattggttctcctggaaaagtgggacaactcgaagtgggggcttccaggtcataggtagatgggagacaaaaggttgcattcttttgggtctttgattagccttttactgaatacaatttacatgtgcaggagggatagaggaataatcacttatgtcttagactggctcagtgagtctgcattttcacataaacaatacggcagagtcagcaatcagataagcatttatctcaggtgagcagaaggatgactttagagttctgtcttttgtttggcacttgtgaagatgagctatcaatttatgaatacattgccagggtgaaattcaacagaagtgttttagggtaaagatcttgaggcccatgtgggcaaattatgagggtgatatgtagcttctttttctttgtagctatcttatttaggaataaaatgggaggcaggtttgtctgaggcagttcccagcttgactttaacctttgacttagtgattttgggttctgagatttattttcctttgacacaacctaataagtagttatgtcctaacaacttagtagctatttgagaagataacataattgaaagaaaaaaataatatgtttattttgttcttaaacagccataactactaatgggaaatgtatctctgttggtcattacaccagtgtctgaaaccttggaatcagattggacacttccaccctcatttcctgttctaggtagatttttagcattgttcttgttttttattacagcaactgctaacagctgcttaaaagtcagctccacaaagaaataatgtcattgaaaggaatatagcacaatgtaatgttcaagctgtgaaccacctggagctagtagttttgaggtattgagcaaatatcactgtgtttccctcgaaaatttaaaatattccacaacaccctgagagtttgctgcaatgctgtaggccacagttcgggagctgttgcagaactagagagttggttttttgtttattgctagtatttaattatgtgtaacacaggttaagaaataatactcatcagtgagattttggaagcattaaagatggatctttctgttcctctttaaaatatagatggggctgggtttgcttctttggcacttgaggcagaactaattaaaaagtgaggacacaaagagataattaagttgtccttgcttctaagtaagtatttctgttcctgcctggctctgaagttaagtgactataattagaaggaaaaaaaaatggaaatgtagatttcccacaggttggtattcttggtatttatttcatttatctcgtagaatttaaaaaaatagtaaatgacaaaattttaaaataacacaagcccagcaaagaatgctggataacaaatgattaattcaggaaaatcttccaaaggatttgtgaaaaagaatactcctttctttcccccatgagtgaactcttgccttctttttgaagttgactattggaaaacccaaagatgcttagacagggcagaatgagaaatagttaatcctctgacaggtgggcttcgataacagttgtgaaatgtaacacatttttcttttcacttatagttggcagaagggccagtgaaatttgaaagttgacctcatattaatcatgggtcatcacagtgtctttacacttggaacatgtgcatttctttgtccatcaaaagaaacagaacaaccgagaaaaggctagagaagaccatcttacatgatttaaggaataaaaagacttccctatgagaacagtctaaattttaggactttaatttggaaagatacagaagcataagttcagagtataaaatgttgactgtacagatctcctagagtcccctttacgctggatatttttatattacctgattatttttttcttaatctttgattattctttatgaatctcgatttattcatgatgttctctccagtgttaagtttgcatttctgaccttttctattgcttgtttcacttttaaggaaatgacttgaagttgttccacccccatggtgccatttaccctgagagaactacagaataaagcaaccataagtttgcccttggtgttgataaccagtagctctgggaataaactatgcttacctgttttctacagcatatggtctgtctagctttcattgcctctctagctgttttgaaaatcccaattagaaagccatgccagcttactaattaagaaaataggccttggtgtcaaagacttcatcttcagatctgatcttattttgctacttaggagttctgatactgggcaagtcacctagcctgtgagcttcatttgcttatacagttgttggaattagatgtggtgacatgcgaaaagcacaaagcctggctcctatcaagcttctgcatctatttttttttctatttttctctcaattattggaagctcatagaagcattttgggatagaattttagtagtttgcaagtatttttaaacattttatcataggtacacttataattttgatatgatctcagtattaacctgataactcccaaattgatattttcctagttcaactgaaattaaagggagaaatatgggattgtaggagtgccttgtcctcaaattgactgtatttctgttttgagaaagatcttggtactgatcacgtagtcaactttctaatgcaatgttaaagtttatatatttgtaaatgttattgttataaaagcataaaaccagaaattaagtcttagatttagtttctacatcttttattggaagatgactgtagataaatatctttctgtatatcattttaataaatgagaaaaaagagctgttgaatgaaagatcatgaacatcagtatttatctgaggaacatcctgcggaggaatccctttccccatttattaaacacaaaattgccagtgtttcaagtagttctctgatcgatagaccaacaactgaaattaaatgcttttagtctcaagtgcccatttttattaaaatgtaattatcatgaacagaaaaagcaatacaaggcgtgtgttcttaataattctgccattctctttttgacatttaaaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttagaaggcacaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaattcttaa

SEQ ID NO: 41 - DNA, 104726 bp, Artificial Sequence
  Based on Homo sapiens sequence
gaattcctagttaataaatggtgttgggaaaactggctagccatatgcagaaagctgaaactggatcccttccttacaccttatacaaaaattaactcaagatggattaaagacttaaacgtaagacctaaaaccataaaaacccaagaagaaaacctaggcaatttaggacacaggcatgggcaaagacttcgtcttttgttaccaaaagcaatggcaacaaaagccaaaatagacaaatgagatctaattaaacgaaagagcttctacacagcaaaagaaacgatcatcagagcgaacaggccacctacagactgggagaaaattttttgcaatctatccaactgaaaaagggctaatatccagaatctacagagaaaccaatttacaagaaaaaagcaaacaaccccatcaaaaagtgggtgaaggatatgaacagacacttctcaaaagaagacatttgccaggcgtggtgctcacgcctgtaatcccagcactttgggaggctgaggcaggtggatcacctgaggtcgggagttcgagaccagcctgaccaacacggagaaatcccatctctactaaaaatacaaaattagccaagcgtggtggtgcatgcttgtaatcccggctactcgggaggatgaggcaggagaattgcttgaatccagcaggcagaggttgtggtgagccaagatcgcgccattgcactccagcccgggcaacaagagcaaaactctgtctcaaaaaaaaaaaaaaaaaaaaatgaaaaaaggctcatcatcactggtcattagagatatgcaaatcaaaaccacatctcacgccagttagaatggcgatcattaaaaagtcaggaaacaacagatgctggagaggatgtggagaaataggaacgcttttacactgttggtgggagtgtaaattagttcaaccaatgtggaagacagtgtggcgattcctcaaggatctagaactagaaataccatttgatccagcaatcccattcctgggtatatacccaaagggttataaatcattctactataaagactcatgcacacgtatgtttattgtggcactgtttacaatagcaaaggcttggaacgaaatgcccatcagtgatagactggataaagaaaatgtggcacatatacaccacagaatactatgcaaccataaaaaagaatgaactcatgtcctttgcagggacatggatgaagctggaaaccatcattctcagcaaactaacagaacagaaaaccaaacaccgcatgttctcactcataagtggaagttgaacaatgagaacacatggacacagagagggtacacagggaggggaataccagggcctataggtgggtggggggctaggggagggatagcattaggagaaatacctaatgtagatgacaggttgatgggtgcagcaaaccaccatggcacgtgtatacctatgcaacaaacctgcacattctgcacatgtaccccagaacttaaagtataatttaaaaaaaagtcagaaacagtatagctattataacatcgttttggcggttttaatcaatgtaatgaggaaaaagaataaaggcaggagagggagggaagaaaatgtatcattacattatcaggaaggaaaagataattacattagtttgcaggtgaaatgactgcctacccaagagaaccaacagaaaactgttggaatttaagttgaaaaatgtggttagttcaaggtatgaactaaaacaatttttcaatataatagcaataatcataagatgggaaaatgaacattcacaacagcaactcaaaatgccaagaattaaaatagcaagaatgaaacaacaaaactctattaaaagatgaaaaagatcagttaactagagctctaatggctttgtactgtatcaactcagctaactcggacttaaaaacatttcccagaattcccttccttatatagttctgggtactgttggctataggagacattatatggaactcacaaatgaagcaagtcatattttttacaccgtgaaggtcaatggagagcacactgtgaagtttgcatgtgctgccgatctgttagctcaccttgctggcatggggaagaagctggacctgcagctccttcaactcccatcagaccttctctccacttctccaaatcctgggcccacaagtgcagctctgacatcgaaagtgtcatcctctcctgcaggttactcaagcatcaaaactagggttggtgagaggctgatgcaggttccgttttgttcccaagggtttcagtttgtcttttctctcatccacatccagtatccctgtctgactgccagtctagtagatctgcagcaacttcaggctgaacaagagactcagaggcaagtctgcagaccgctctgccacctcccacaattccataggtctttagctcacaaagtagttctgcttctttgatggatcctaactgatacaaaagccagacctttttttttttttttttttttttttttgcataagaagacaacactgatggtgttattctctccaaattaatctataaatttaatgcaattttaatcaaaatcataaagggattttcttctaggaacttcacaaaataattttaaatttcatttgaaagagtacatgctaataaacttttgaaaaaaaagtagcataatgtgagtacataaaggtgaatacaaaatcgagaaccagacccagtacgtatatggtggggagaaatgtgtacataattctgaattggtagaggaatgatgtaatatttgacccagatctcgttatcagctatggttccaagtgcaaggaagggcaaaaacagttttgtataagtaaaaaaaaaaaaatattaaaatttttgaggccaggagtggtagctcccacctgtaatcccagcactttgggaggccaaggcaggaggattgcttgaggccaggagtttgaaaccaacctgggcaacacagactgtctgtactagaaaaaaaaaaaaaaaaagccaggcgtggtggtgtacacctgtagtcctagttactcaggaggctaaggtagaaggatcacatgcgtctaggattttgaagctgcagtaaaaaactacgatcgccctactgcactccagcctaaatgacagggtaagaccctgtctgaaaaacaacaacaacaacaaataaggaaattgggaaatcacagacttgtcaggttttgaaaaccaggctttgaaactatccctcaagaacttcagttaaaatgacaccagacacaggccgggggcggtggctcacgcctgtaatcccagcactttgggaggccgaggtgggcggatcatgaggtcaggagttcaagaccagcctgaccaacaccgtgaaaccccatctctactaaaaacaaaatacaaaaaatttagctgggcatgatggcgtgtgcctgtaatcccagctacttgggaggctgaggcagaagaatcgcttgaacccaggaggcggaggttgcagtgagcagaatgcgccactacactccagcctggcaacagagtgagactccgtctcaaaaaaaaaaaaaaaaaaaaaaggacaccagacaactggtccgatgaagatctccctgccaccaagcccagcttgcactgaccaaactcctgtcaccaggtatttccaatggcattgctgccagtgctgccttgtctgctgctgctataaaagattcttggcagtatttgtttcttgctctcaatacaaaattcggagcgaggtaaagtatgtgtctgattggctaagtctaggtcatatgaccacactcaagctgcaaggctggagaagacagaagagtatgtggccttttcagtatatacagatggtttcaacctacgatggttcaatttattatttttttgactctacagtgggtttgtgggcgttaatgtattttcaacttatgtaatttttgacttacgatgggtttatcaggacatggacaccatcataagtaaaggaacatctgtatagatgaacatgggttctatcttccttcacaatagattggaagaggaacctcccaaatatattacattgaacaggaaatgacctgtccatatcggtaatcactaggtagaaaaggctataattactaaataccactgaagaaaatcaatcatcagacaaaacctagtttggataatcaactttcagtctctataatgtaattttatataaacaactttagattttaaaacgtcacaccccatgttttacaatatagactctttctctgattaaattaagaaagggaatcaatttggttgactagctgcctggaaaacttccatggttagatagcttttgtgatcaactgggttatcaaatttgggatacttatatgaatttgtcaacagaattctacatagtccagctaactagaggagcccaaaaatatttttaaaaatctgataggaatgactatataataatgtaaagcttttagctagaagagctcaaaattatttttaaaaatctgataggcatgactacacaataaagtttctgcatggcaaagttaaagacaaataaatggaggaaatttagaacatttatgacagagaaagattagtagccctaatgtattaagggctcttaaaattaatacagaaataagcatcccaataataatgtgggcaatgtacataaaaagacaatttggaaaagaaatacaaagtgtcaaaaaatatgaaaagatttcaatcttattagtaatcagttgaattcaaattataacaatgagatttcaatgtaagactgacaaaagattactaatactctgtgatagtaggagtagggaaataatgatcactctcaaagattattggcaagaatgtaaattggtataaactttctcgtggtcaatttgactatttatcaaaaaccacaaaaaataagcaaacacttttgatgctacatttccaattccaggaaaataaggaaataattagataaatatgaacagctatatatgaatattcagcatagcattgtttacaagaaaaattttaaaataatgtatatgtctgaaatatggcactagtgaaataaattccacaaatatgcagccattaaaaaatacttattctcatatttactgaaatagaaagatgttcattaagtattaaaatttaaaagataacctataaaataatatgtaaaaaattacatttttgttaaaaaatatatacaggtctattaaaaaatctggaagactgtttatttggtttgtttctcagcggtgggcttataaatgtaatcattactttttttccttttttgaatttttgaaaaatttcgatgtcttactgttatgaccataaaaccaataaagctactttgaaaagttaaagccaggagtaattaaacaactcatacttgattgttaaagtcagtctcttaaaagtgtaattttaaaaaggtaataaaaaaggtataacattataaatatatattaatatgcacattaaatatataacactaattggtattaataaaattacatccaatctcataaatcaaatttattgtataacataacaatttgttcatagttatgtaataatagacacaagaaataacttatgcagattccttatgtgaagcgtacttactttgcagataacaactattttttaaatgataatggagtctacaacaatgctcattcttgatcatttgcaataatgaaaattgttctctaaagcattaagatggattattttctatagattcttccaggatctggaaataatgatttccaggtactctcaaccaagagatgtgaccaaaatacaaaaaatgcaaaacatatctccattacaaagtcatgaatcctttctataaacctcaggatttacagtgtcacaaattatgaatcattgtctcctttagaaaacaaacattcaacacctgaatggataaagaagtcaacatatttaaatatttaatgcatataactttaaagttgataaaatgtccctttcaactaaaaataaatgcccttatccacttagctggactgaaacagggacactgaaaacttgaattaatggccaacccagagcagcggcagcagcaatattcccctccttcaataaagtatggcctgtaagttagccctaatgagaaagaaggccattcaggtatgagaagaacctaggctgggcacagactacacagacgcctaacacaaaagctctgctgccactcaatctttgtttatatattatcacaaattttcttttctttttttagagacaaagtcttgttctgttgcccaggctggagtgcagtggcatggtgctaggtcactgtagcctctaactcctaggctcaagcaattctcctgactcagtctcctgagtagctgggactacaggcaagtgccaccaagcttgggcaattttttcttttttcttttttttttaagagacagggtccctctatgttgtccaggctggtctcaaactcctggcctcaagtgttcctcctgtctcagcctcccaaagcactgggattacaggagtgagccactgagcctgacccaattacaaatttattttcaaccctcattccagaaggaagacaaaaataaaaagccaatatccacttaactgcaaatttcatgatgtccttataaagccagtgcattatattttctttcactcatgaagcaatttttaataatcacaatatatatttaaatgttaataaccttacttttttttttttttttttttttgagatggagtcttgctctgtcgaccaggctggagtgcagtggcgcgatctcggctcactgcaagctctgcctcccgggttcatgccactctcctgcctctcagcctcccgagtagctgggactacaggtgcccgccaccacgctcagctaattttttgtatttttactagagacggggtttcaccatgttagccaggatggtctcgatctcctgacttcgtgatccgcccgcctcggcctcccaaagtgctaggattacaggcgtgagccactgcgcccggcttacttttttttttttttttttgacaaggtatctctgttgcccaagctgaagtgtagtggcacgatcatagctcactgtaaccttgaactcatgggctcctgcttcagcctcctgagtagctaggactacagaaatgcacaactatacttggctagatttttgtttttaaagtgttttgtagagatggggtctcattgtgttgcccgggctggtcttcagctcctggcctcaagtgatccttccactttggcctcccaaagtgctgggactacaggcagaaactaccacaccgaacctactaactctacattttacatgatgagttcagattttaaaaggattagtttgctaataaagtgtcgtgagcaaagtgaaaaatcaaaagattacttgaagtatttacatgatgatccaaatttaaagcgacctcaacaagcaaaatttactgtttacaaaaaactgtatcacggtttacgaataggaacacatatattatatataatgggtataatgcgaatgcattttatcaatggaaagtacaaaacagcttgctgatgaaagaggaaggaaaaagctcacagtgaacttggaagcagatccttcagccccagtcaacccttcagatgtccgcagccactgccgacatcctgactgcaacttcatgagaccctgggccagaaccgccagctaagtcttgaccccacagaaagaataaaattattgtctactgttttttgtttgtttgtgttttgtgtgagatggttcctcgctctgtcacccaggctggagtgcagtggcatgatctcggctcactgcaagctccccctcccgggttcacgccattctcctgcctcagcctcccgaatagctgggactacaggcgcccgccaccacgcccggctaatttcttgtatttttagcagagacggggtttcacccgtgttagccaggatggtctcgatctcctgatctcgtgatccgcccgcctcggcctcccaaagtgctgggattacgggcgtgagccacggcgcctggcccctactgtctactgttttaagcctctaagttttggtgtaatttattacacaatagatacgtagaagagaactatttctatttttaaggaaggtataattgcagttccagaaccccacatttctggcatctattctactccaacttttggtgcagatatttaacatctggctcagagtctgagtattagaaaaagagaaatttactaagtgttcttcctgtattacttattgtctctgaataatacacctaagggtacccatttttcttcttaaactttttatttccttttccacttcctattcctccccctacaaataaaacggactcccgaacctccttttacatattcacttttgttgataaggttccttaagagtagtgatctcttttaaacttgtcatgtttaaaaatccagtgtgctcaaggtatttaataaatattccattttactaatacaagagataatcacataataaatccgcagcctatgaactaaagatactgtttgggatagcttctctgacataactgacatattataaattcctccctatgactcgcagaagccactttctgcaatggccaaactttgtcacaccccatcccccttatagcaaataccactaactttggggccttcagagtatacataacagtacttttctccttcctgaattccacaaacatataattagctggtcactttaattatacgctatcatgtattgtttgctaataatctcttagacattatttctgtcaaaacaaataagagctgatacattctctaagtaagtgtcatctgttttaactttccctcttccccaccaaccttacacattatatgcaaaaacccaaggtcaaaacacggtccaaattccagaaaccgcctttattatgctttaccagtaagtcttcttcactgaactgtagttgctgtaaacttaatatatttaatttctttaatggaaaaatatcaaaagcagatgccaaatctgatgcaactaactgacaaaggaaacacaaatcttgcttactttcactgaaactttttattgccatcagatgtctgcacttaaaatgtttagttcctatgcccattacgaataaaacaaaattctgtatttcaacatgtttcaagcctcagaagttcccagacatccttttctgagtctggtgtgatgcaataatttttcaaatgtcatttaaaaaaatgggccaggctgcagggaaaggaccatgtcacactctcagcattcaagcctcaaaggctccggggcacgaaaggctcttacaaccggttaaggacggcaatgggctccttcggcacgactcccggaaccccaccctgggccagaaaaaggccaggggcgcggagcgtaggcggagggctggggttctagggatctagaaaaagcgcgaagccggagggcggcgccagggctcctcgcagaccccagggccgcgggacggtgccggctcgtgggtcacacgcacccaggaggctcctggctcccgcgtggcggctgttccagcacgccctccgacccgcaaccggaccctccagacatcagactcagtggtcccccacctccggtctcccacctcaggacgcagttccgcggcgtccacccggccccctcccctcagtcccacgcagcggctcagccatacccaccccggcttctctgagttcaatccagcagcagctcgagcagcggctccgcccctcggtcggagccatagagacgtcggctgccggccagagtggcctcagaccgcagcgtcggccgagaggacgccgggatactggccagctccaagtcgaaaggaagcgacgcatgagttgtttggtgcggtgggtagatacctcgagtttctcctcgcccaccgtaggccccgacccctaaaaaggaaacttttgggacgtcagagtgagaggagaaaagtgtctttttagtttagttttgtcaaacctgaggattcgtttttcagtttagccggagctgtgccgcaaacgtagctgccgacatccccacgacgcacccaagtggtggcccggaagctggggatagaaaagtggcctccccgaatgccaggcacacaggccttactaccagaagcttgagctgggagcctcggccgtcgcatctctaaggtgcagcgatacggccaacttccttccgcgaagccctcagggtgggcaacggagcttttcaccagactgagggaccgggcgacctggccgaccggcggctcctcaccgcccccttggggatttcttgataattctttgccacgatgcgggcggatgttgtggagctactgtttgtagatcgcagtagcgtgacagcacttaatcatgactactaaatcctcagaagtcgaaaaagcaagtccatacagaatagtttgaccctaattaaattgcgcttacaagatacagtttgtttactgggactttggctaggtcccatcccgtctctgcctcagagtggtggttgctcttagcaccaaggaaataccagcttgacatttgactctaggaagcacaggcccaaaagaagaggcccaaggagggacattcttctttccctttcctacctacagtttctcaaaccaagtgtcagatggaaagcaaggggtggtatcatcgtaattatacagttgaccatagaaaataaatttcaatctcaaagtaaactaggccacccccagaatcttagagtttctcaatcatagaactcatttcttgtcacagtcttggttcttagccaatgtaaaagacccaactgacagggaaaattaaacaccttttaactcccacacaccttaaatgagaatttaaagtatctttcagcaaatgtatttataattttgagtgcttttagccatgttaaggacaaattttctccttctgaatgcagtaataatttggcattacccttttggcagtgtggtacaaagtcttataatctaggctttatggagctattgaggaacaacatagatggcttcatgcaaacccaaacaatgtaatagtagttcttttctctgtagtcggtctactgcctgtagatgtttattccttttttttttttttttttttttgagacagggtctccctctgtcacccaggctggagtgcagtggtgcaatcatagctcactgcagccttgacctcctgggctcaagggattctccggcctcagcctctggagtagctgggaccacaggcacatgccatcgtgcaggtaattaagttttttgtagagatgggcatctcgctatgttgcccaggctggtgttgaagtcctgggctcaagtgttcccccctccttggcttctcaaagtgttgggattacaggcgtgagccactgtgcccagcttactgattcatttatacaaacagagtgctctcagtgtgctacagaatgactatggagctcaagttctagtggagggtgtgagccacaaggaaacaagctagacagattgtaataagtactataaaggaagtaaatagggtgatgtaatagacttgggagatgctaactttagtcaggtagtaaggaaggcccttttgaggaaatggtacttgtttgagaattgaaatgtgaaggaatccagtgtcagaggaactaaaaaaaaaaaaaggcattgtgcccctttaacttagtgacattatcattcctgatctacactcttctccccatttttctcgttttctctgttactgcttcccgtttatttgaagagccaggtcttttatagaaatcagaaaattagaacatttctggttgtgtttggtgtaatcttgacgtcattatagatatttggttttgttctttcttaatagacaagcttataataaatagcacttttggtgagctcatttctgttaaacactttgcagcataaatcttttcctgtgttcaaaagaaagtatctggttcatgagacagtttagatacagtctttgccaaagtgcctgatttttagtttacaatgttgcttgtctccgtttttgtttttgagatgtagttcttgtctcatagctctactgaaaaatacttggagtaaagggaccaaatagcaagtgaacaaatgcacaattctgcatattaaaaaaaagaggctgggtgcagtggctcacacctgtaattccagcattttgggaaacggaggcaggaggatagcttgaagccaggagttcaagaccagcctgggcaagatagggagattcctgtctctacaaaaaaaatttttaaaaattagccaggcatggtggtacatgtctgtggttccagctactcggaaggctgaggtgggaagatcccttgagcccacaagttcaaggctgcagtgagctatgattgcaccactgcattgcagcctgggtgacaaagcaagaccgtatctcaaacagtaaaaacaaacaaaatgaaaaaacctgaagattaatagtgaatgctccacaagataaaaacagcaacaactttataatgttacaaattttttttcttgttaatctgaaataagaattaaatgtgaaacgttcaaaacttcgaaatatttattattaagatataaatacatattttaaaaatgtacaagttaaaaataccttcaaagttaaatgtcagttctttcacaatcattgtgccggggtaatacgtacaatatcttggcttactagtaattttataccagtcacttgaaacaacatccttaaactttaataatatgttgtaataattccatttttcactttttagagtttgatagaagacagtcaatatcgtgaaggatttcagaggtttttttcaatgctattgatactctattttcattaacttctcctagcaaggtttctgaagatcctggtttataatgatcaaaagactgttgttcatttttcttgttagaaatctggtttaggataccactattttctagtagcactaagttgcttagttaaggaggttttccccacatttttcactatataaatatctttatatacagaaagcataggcttcatattaaaatatttctcagctggaagacctcttggattcataatacagttggaactgcaaggcttatcaagtctgctccttgtagatgaagaaactaattacagtataagggagggggaaagagaatagagtgtgtatgtgtgtgtttgggtggaggtttggtggtaaggaggaaatgaaaatttcagtaacatttctttaagtgaagaaatgacacgggaattaaagagtaggatgacaggattataaggaatctgtgtagtgtctatttttaatttaaaaagatttagagtgaaaaacctgttcgctatagaactaacttatttgaataagattagagaaaaaccacaagagaaaacaaatttagatgaattgggtgagaatgtacagaatgaaatatttcatttaaaaaaagaggtcttaaacagttataattttattatataattatgtaagtgaaaaagtctccaaaggagaccttaaccctaattaactgttctttgcccaatttaaactcaaagaaaagtataaatgttaacatgctgtaccttctatggacaagatccatcttaaattacaatcttaggtatttgctgactcaataaaggttagcaatatattaagtatagattaatattcacaaagtactgaagtcatgaattaagcctagaatgaaagagagtaattatgtaggacagtgcattctgtttaaaggatacagttaaacttctgtatcttttcaagttcagaagcaacagacctgtccaaggaaaaagaaaaaattcattcagttgtctgattcttttgtattcatgatatttcaaataagcatacctgactttttttttcattagaattttaaacggaagaacgcagaagaattctctttatgttacctttatttagcaacaaatcaacttgactcaactgatacttactgagtgcctttaaaggtaagtgaataaaagtctaccccttgtaaatccacttcaaggaatttgtaatcaaatattgatgtttgaggataatgggccttcctgttacttcttagtactaacctagcttacactctactttcctccctaaagtttacgcaaactttacaaacctattaaaatcccattccttctgtgaaagaactgctctctccttccttgaattcctatagcatattaattaatcacatacttatttgtaatatcttctcttgaactatttaacttcctgctcttcctacctagattgtttctctcagaagaaaggattttttacttttctgtacttgtgcatatattaagacctcatttatatggaactctttgggaatggatggtatgggagatccaagtttttaaatagttgaattacgtgtcaaaacaactattttttattaaattctttctggaatagactacctacttatttcattgtttttttaagcacagagggttaacatgatgaacattagctcttataccatgttctatagaaagatagtgggacaactggtatggagtagagggctaatatatacgtctccagcagaacccctaagtgtgtgttctttatcctttttcttatcaagttagaatgaaatatgagcaatggcatacaactacaaactgtaacttgactagctctctgcaaaattaatgaagacattagtctaaaatattcaagtcaccagaaaaatcttcacagttcatagtagggtgtgtgacttgtctgctttattggctttactacaacagatcacatgcacctccctgtcagcttgtactctttcccttgtactccagcctatggatggagaatgaaaagaaatatttcataattttaaacacctgtggcaaagaacttggatacaacttaccccaacaaccagctgattgttcattattgcaaaatatctttttttttttaaacccaacgcatttttctggatgtaagaaacaatacaacctttattgttattgctctcataatgaacgaactttttatgaaacgtactatttgttgactaaaaagttgaattaataagctaataatggagggtgtggcggaaaaaaaatactagaatacaacttaggtagctttttattgtacaatcttgtttcttccttcaacctaccctctttgataagaaaaaccgaagtggagatacctaaggctttatagggggaatggagctactcctcaatttctttatcttgcctctgctgttcctagttgctttcacctttagctactatcaccaatctctacttgcagtttttagtgtgtattgacagcctcttctcagctttcaaataaaaaggctgatgatattttacaaactgccagctaagcaatggtgaagtgatggttttatagacaagtacaattttccttccatcacaattgttttttgctagttactttagcaacttttctgcttccaaacaggctacagctaaaggatgagggatctgcaaagctggatccttaagctacctgagatattcaaataacgcttactgatatgatttgatttgttctaagaaagggcttaggaaaaggtaacaaaaattggcttaatgtttacattttgtttcactacactatgttaggtcacctcacaaaacttacttaaaaagcttcccaaattgttcctggtatccctgtcttcccatatattcaggttagactctcagtgacactaatcttctaatgacctttcttcctatcatttttccatttaggactttctaattccatcaggtctgaactcctatttattataagatccattcctagccctcaaaactcatactatatactaatagatagcatatgttccataaaaactatcttctatctccacaggctaaaatatcctttttacttctgcccttatttcctccctaaaatgtcttatattttcacagaaagttcccttgaagcccagttctagtaccctgcacactgaaaagcacacaggagggactaaaatacttgctttatttgatctgccagttaatttgggagaagtaactaatatgacagaaattatttaaaaatcaatgttttctgaaagcttatgttattaaaccttttatttccttcaacattactaaaaatttaagaatcccctttaaatttttccataaagttttcaggatgaatttgtcacataaaaagagccactcattttcatgttaagttttcaatgcaaggttttcttacctttaggtaaaatagaatatgatgaaatgtaataaattagatgtctgattagaaattattttcaagcttaagctatcaaaaatactttaggagttaaacatattcaaaactaagaaagtttttttggggaaaaaagtctcagtttaccatttgacattttaattttttttaaagtattagctcttctaaacagatttaagtttaaaagaaaaataccaattttcttggagaacagaagatgacgaatgagtgggcatctctctgggactagtctgggtcagtctcctgcaccatgatgttactgttgtcacatatctaaagtgaatacattaaaagaaatacttgaaaaatgaacttgaatacattataaaattataaacaaatgtaaaaataagacaatttgggaaaaaaggataaagaaaaaatgttaaagtgaagcatttactgggcaattctcaaaatatttttcactggtcatagaaaagccaaattttttccattattcatcaagaataaaatgatttacttatatttgtgattaatacaagtgacatttaagaatcaaaataaaggcgatatttggatttcatttaaagttcaattttaaatgttctaattcttttagtttttcaaagtaaaatgcgtttaagttttatcaaaaaatattcacacaaaataagactgactgagcatttgcttactaaaatttaaaccaaaaaacacctgctaatgcatatacacatatgcttgtatgcatatgtgtaattatatgtaacttactacatatctaaaacaagtatcaagtttaataaaatgaatgatctgaaatgattggctgaatcaatagaaatgtttgctaaagaaactatcttttttgaggcaaatcattaatagcaatgaatgagcacttagactgaaacacaataaaacccaacagaaaaatacattcaagaggtaacaaaaagctattattttgtgaatattctcaagtgaaatcactaaaatgtgaagactatcacaagatttactgtaataaattagataaaccaaaagaaaaaaaattcataaaaagctgaagactcttccccattttaagataatcattgcgtaattttatccactttatagaaatatacagaatttcagttatttgtggttgcaaatcttatttcaaattggctagaggattagttaattgttaacacagctgaccatatccaacctccacagcaaatcagtatgtctataacacatttcattttgaaaagttacttgaatacaaatgaaatgattaaagctgacctgaaggccgggcatggtggctcatgcctgtaatctcagcactttgggaggccaaggtgggcagatcacctgaggtcgggagttcaagacaagcctgaccaacatggagaaaccccatctctactaaaaatacaaaaattagccgggcatggtggcacatgcctgtaatcccagctactcaggaggctgaggcaggagaatcgcttgaacccaggaggcggaggttgtggtgagccgagatcgtgccattgtactccggcccaggccacaggagcaaaactctgtctcaaaaaaaaaaaaaaaaaaaaagctgacttgatctatttagttatgctaaacacaagtacagctatcaactctgaaacgactgaaatgccttcattattatccacatggaaaaactaaaaatatatataacacttaaataatgcttattgcttattctctgttagttaaaagtaaaacataaaaataatttttaaaattgcttttcagtacctttcatatggttcagggtgttcaatctgaattaactgctcttgtccatcaggaaaagttaacttacaccaacctaagttaagaccttgatttacctgaagaagtagaaagataagttttatcattttagaactgaaaaaaagaacataaacaacctattctaacttcattaacttaaagaaataagtagaggaatcattaaagatgcaacagtttaaatgttgtttacatgagatatgggtgttatttaaccaccactcatataggtaattatcaaagcaaatgaaaatactaatccctttctctataatcagttatctttagaaaagtgactatttgtcaaatcattctgatttttgctaggaaatccaaagagatcagtaaagcttcttgacagattttatacttcaaaaaatgaactgaaatagtgtggtactttgttttctttgttctgttttccacagattaccaataaaaaatagatctaagtctgaagtatacccacctgtctcttctcaataggagagctgaaattccaatttagggttagagtaatgccatctaaaaagatagcatgtactttgtcatcagagtaggcaagaaatcttcccacactgggtatgagtgactctttcaaaaccaaaggcagtatattgctatcgtttatcccaggtacctaaaaccaagtaaataaaaatagcaggaaatagagttatctaagaacaagatttaaatgaatattaatgactctagggcaattttggatacttattcagaagtcaaatattataaaatccttatattttaatttttccagaagtggatacccaaaacagtctttttttcaagcagattcagttataatatatttgtaaagtcactgttctgctctgaactttacatccattatagacaaaaattaggagcttacaggtttgtaattaaatgaatatagatacagaaatcaaagtctgagaatcacttcctccaaatcagcattaaggaatttatttttacggttatgaaaatatagaacactataatatcatggtttataatgactaatgattttacatacttcaaatccaatcagttcccctatcctttcctcttcatgaaaaataagaaccatatacaataaaactataacataaaagcctgaactttcagtgtttgtctactaggtaggtatttttctgaataaaccaacattaatgttacaagaatttctcacatgacttagaggaaaactgtttgaactcagaagtatggatataaacaataaaacaatttaaaaatatcttgcttttaaaataattttaacataccattttccagcagcatatacgatagttatggcttaaagaaagtctcatcttcacacaatgttgaagaattctgtgaacacaaaaaatactacttaaacatttgcaaatgacattttccaattctagcaacccattttcactgccatacaacattttagatgatcagtaaatcattttcactgaaatgtgttgggaactctttttttctccagaaatccttaagcccctagaagggaaatactgttgcttccctttgtgctaatcttacctacttaaggctattcctttaatttttagcaatgaaatgattccatggacagaattttcaggaactccttttttaagaggtgatagattcacactgcctggaaagtttcacataggctaaaaatggtagggatgtgaatcaactatccctaggaaatcaaattacagaatatgcttcttcaaatctattttggaaattgcttgtacataaatttataaaaagaaacaacagtccacttgcattcttctgggtatcatagattgagagaattttaaaaacatatgaaccaaagaaccaatctatgctttatcattagtatattttcagaaatctattactctgaagataataaagaagtataaaaattttaaatgtaacatcaaatctccaacttgatttcaaggaacaataatgatgccacacttatgcaaagaaagggcacttacttcctctcagcacttgctcaccatatatggatatttctccatatttaaattacaaagccagaagtaatcttaataaatgacacaaaaattaccttattttataaattatgacaccaaaaaagttgacaaattttaccgaaggcatatatttccattgtacctgccaattcttaatcttatccttaatcacaagaaaatgtgccaagatgtttagacacataacatttgattcaattgaatgggaagaacttaccttgttgcctgtttaattagagaaccgacagtgaatggacttcccggtctatctggaggaaggttatttactgagtaagttttctcttctctctgaaaattagttaaaatgaaaaatttcattaataataaattttggcctttattacttagctgcttttccttgaaatatgtttttacaatagtgacaagacgagtagttattttaacaaaataaagcccacaaaatcatggtattttatgatgctttttcattttcccattttttttttctcattaaacttttttaacaggtctcaaaattctgtgacaaatttttggtcaagttgtttccattaaaaagtactgattttaaaaactaataacttaaaactaccacatgcaaaaaagaaaaccaaagtggtccacaaaacattctcctttccttctgaaggttttacgatgcattgttatcattaaccagtctttcactactaaacttaaatggccaattgaaacaaacagttctgagaccattcttccaccactgattaagagttgggtggcaggtattagggataatattcatttagccttctgagctgtctgggcagacttcgtgaccttgccacctccagcagccttcttgtccactgctttgatgacacccaccgcaactgtctgtctcatatcacgaacagcaaaatgacccaaaggtggatagtctgagaagctctcaacaatgggcttgccaggaaccatatcaacaatggcagcatcaccagacttcaagaatttagggccatcttccagctttttaccagaaccgcgatcaatcttttccttcagctcagcaaacttgcatgcaatgtgagccgcgtggcaatccaatataggggcatagccagcgcttatttggcctggatggttcaggataattacctgagcaatgaagtcagctgtttccattggtgggtcatttttgctgtcaccagcaacgttgccacgacgaacatccttgacagacacattcttgacattgaagcccacattgtccccaggaagagcttcactcaaagcttcatggtgcatttcgacagattttacttctgttgtaatgttgactggagcaaaggtgaccaccacaccaggtttgagaacaccagtctccactcggccaacaggaacagtaccaataccaccaattttgtagacatcctggagaggcaggcgcaagggcttgtcagttggatgagttggtggtaggatgcagtccagagcctcaagcagcatggtgccgctggcactgccatccttacgggtggctttccatcccttgagccaaggcatgttagcactcggctccagcatgttgtcaccattccaaccagaaattggcacaaatgctactgtgtcagggttgtaaccaattttcttaatgtaagtgctgacttccttaacaatttcctcttctctcttctggctgtagggtggctcagtggaatccattttgttaacaccaacaattagttgtttcacacccagtgtgtaagccagaagggcatgctctcaggtctgcccattcttggagataccagtttcaaattcgccaacaccagcagcaaccatcaggacagcacagcctgagatgtccctgtaatcatgtttttgatgaagtctctgagtcctggggcatcaatgatagtcacatagtacttgctggtctcaaatttccacaaggagatatcaatggtgataccacgttcacgctcagctttcagtttatgcaagacccaggcatacttgaaggagtcctttcccatctcagcagcctccttctcaaatttttcaatggttcttttgtcgatgccaccacatttgtaggtcagatggccagtagtggtggacttgcccgaatttacgtgtccaatgacgacaatgttgatatgagtcttttcctttcccattttggcttttaggggtagttttcacaacacctgtgttctggtggcaaacccattgtgggaaaaaaaagccattttcccattttttaaaaatatagaattactcctattcattcaaaagttttttttaatttttttttttttttttttttttggagacagggttttactctgttgcccagggctggagtacagtggcgcaattacagctcactgcagcctctgtggctcaaggagtcttcccacctcagcctcccaagtagccaggaccacaggcacatgccaccataccgggctaattttttaagtttttttgtagaggcgaggtcttactatattacccagactagtctcaaactcctgggctcaagggatcccaaagtgctgagattacaggcatgagccactgtgcctggcccaaaagttacattctaataacttattgtgcaatttaaatattagctacatttacattaacatggtaaccaaactaattttcctacacattagcaggaaatttatcatgagccacccctttcccttaagacaaaaagacatggatatatagatttaaaaaaactattttaattgaatgaatataccattttgctacattaatggaagaaatactgctacagtttgtggaagaaaaaattatttacaggcggaggttactgaaatttgaaaaaaattgttattttaaaattctttctgagtttcctcctcctcagacttgctagtgtttcccagcactctgtctccagccttctcttctgacttcttgatttctttttagataatactaaaagggtccaaagctgtgttcacattaaatatcataatagcaacagctaacatttgtggagcagatactatgcgctaggcactatcctactcactttacatggattatctcatttattcctcaaaataattctgagataactattaatgcttgttcttcagatgagaaaactgagactgagggctaagaaacagtagagatctgatttaaaccaccaagagagtgcagctcatactctttaccattaggggaagaagaggggcttcaaagtcagacagatgtggattcaaatcacaagtctgcctcttaccaactataatgatgggcaggctatacaaccttttgtaagcctcagtgcctgcagcctgtgaaatggggatactgcctaccatccagacttatctgaggattaatgatataatatacatatgaagttcctgggacagaatttagcatataataggtaccaaacaaaagtctttgtccttttatcttggtctacagacctgactatctaaatctctattgggcttctcttttggctatgaaaacagacacctcaacatcaccatgttaaaactggaattagcgtcatttcaaaatttgcactttcactttctctacgctgtatttacctttggtatgtcatttatcacgttgttccctctacctagaactcagttccctcctccagcacctccctttgcctagctaacacctgtttttccttccgtctcagggaagccattgcagaggtctcatagactaggagaaatcccctagttatgtccacaagcacagttccctctaatcctgcctcttggtcttaattacaacttcaatttaatagttttttacttaatgtctgttttccctgttagaatgcagctccatgaaggaaggggctgtgtctgttttgctcatgtctgtatcattatcatttattagcacagtgcttagcacatgggaagcactcaaaataccatattttaattatttatgtctttctctactggatattgagttccctctgggttcttatttccaagaccctatttcatcaactctaaaatgctcatttttcacaatttaacctctctgaaatctggatccatcttacaattaagagtgtcttataatctattaggcaggtggggttgagatatagttgaattttaataatctcaaatccttaattgacatctcatggtaggcgcaaaagaaaaaaaagccatcatcaaaaaaatttagatttgataaaaattttggtttcacacagtaccgggcaccaccattcattgattaataatttggcatccctttcaactccttcctcatcctcagcgtccagtcagcaatcaattctgtctccttaatattccttctcatttttcctaccactgcctggccttcacttgaactactatacatgtcttctgactggttctacagcttcaagttttacctcttccccacccagttcatcttcctctgaaataatctaacaaaaatctgatgtcacttccctacttgaaatcattcaatggttccccaaatgcagtgaggttactcatgctccagttgtgagctggccatcttagtgatctggcttcttctctggacatttcccccagcatcccatctatgttttggcctaccaaactacaacattttcacttccttcaacactccacactcgccccaggctcttgtgtccagttaggtgccatttataaactgtgctaagaagcagcaataataatgtgttgaataagatagggcttaaatctagtgtagctgataaagaacatacatcattaagaaaatgtcacccaatattcagtgctttgaagaaaaaacatgaggatgtcatgatagggagtgtcttgggtagcttctttaatttgaatagtcaggaaaagcgtctgtgaggagatgacatttagatagaaatctgagtgacaagaagccagccatgcaaacaattgagaaagtaaattgttcccttagctatatgctcctcctacctccatctgtcttttgtacaactcctcctttggaattatagatcctagcttagccaagttttccttcaggagttgtttctggagcctcaaacactgggtctggtgccctttcttatgtggtcccaaagcaccaagttcttatctctatggaagtacttacactgtgagtacttgtcaatctttcctatttcaatttttaattatacaataaataatacattaagtttttgttaaaaaaagttcaaaaagtatgaaaattgagtcctctcagacttctcctccctcacaaaatcccacactctttcccaaacatagctacttcagtgtgtatttgcccaggatccttacttgtgcttgtgcatgtgtattacagaaagtactatataggtatgggtttattttttgttctttacacaaaagatatcattgtacgtgttctaacgcaagtttctttattcgctcaacaacccgatctttgagatcttccagaatctattactgtatgcatcgacatctacctcattcttttcaactactgtacaccattcccataatttgataattacaacttatttcaccatttccctattaatgaacatttatttaggttgcttctgattttttgctgctacaaataatgccacaaaacacacccttggccgtgcttctttgaacacgtgcaaatatttctctaggctagatactgagaagcagaatttctcatcaatttcatttgatgttatcaaattgtcctttaagaaagccaaaccaattaacacttcaaccaacactatgaaagcaccacttttcccacacccttcccagcagatgtcatcagtctttttagttattggcaatttggtaagggaaaaatgttatgtcattgatattttaatttgcatttccctgatgcaagtagtaaagttgaatatgttttcaaatattatgactttttaatttacattatcttttctatggctaaatccatttttaccctttgcccatttttctattagggtattttggttttttggtctattactgatttatagtgtggaatatcttctgggcttttgcttatctttttaacagaaattctaaaattttcttttaattaaaaaaatttttttgagacagagtcttgctctgtctcctagactggtgtgcagtggtgtgatcttggctcactgcaacctccacctcccaggttcaagcgattctcatgcctcagtctcccaagtagctgggattacacacaagcaccaccatgcctggctaatttttgtattttcagtagagacgaggttttgccatgttggctgggcttgtctcgaactcctggcctcatgtgatccaccagccttggcctcccaaagtgctgtgattacaggcataagccactgtgcccagcctaaatatttataatttaacgtaagtttgaagatttcaagcttgtcaaacttttcttttatgccttctggttttctgtattctacttaacaaggcctcctttacccagagattttaaacattgttcttctatattttcttctaacacttataaagtttggtttcttacatttagctctttaattcatctgaaatttattttggagtctgggttaaagtaaggagcaaacaactttatccccaaaagagggtcaattgtttctaaacctttgcactaaaacagacagagaaaggtgaaggtgttgcacacaaaggttggagagtgaagcccaaggcagtccaccacaaatgcgttttaacccaaaagctcatgcttctactccatgatatatttgctttagtataaaaattatcaccccctcccgcaacagctttgagtaaaattgaagctccaggaagacacactccttttatcttgcaattttgcacaccctctgatatacagcagtcagcaatatgactatgcatacctactctatttgcttgctcacttgattgtctgatgtactatataaacacacatacacacatatatacgtatacatgttactgggcatgcttgtatctcatttgcttgtttgcctgtctaactgaacacaagactgtgaactcttgagggcaggaactcttcttcatcttcatccttgtcagtgcttaccagaatgcctgccaaagagttactgttcaattaatatgtatttactaaatattttcctagaaataggccccagttgggaatctgttccaatatatactgaagtatttatgaagaaaacaatatttggttgggatttacttaaaaataaacagggagtggagggagaagcaggaagtataaatgaacaagatgggtgatgggtacataggggtcccttatatttgtctacttttgtatatgtttgaaatttccatagttaaaaaaatctcaatttttaactctattccctagggattctgataatctgattagtatttaaatactccactctgtaatgaagagagaaaacatacttattttgttctagcatgcaaagtagtgtgatactatagtgattgctgtgaaatggtagatgtcaaatatcagaggggcaataagcaaattaaaactcattaacaaaatattgacattattaagactatgggctggtaattataccatgttatgtttcactgttttcagcaacagagaacaatcttattcaactgtctagttgtatataaagatttagaagttaagaggtgcttaaaatacacaattacatggtggggaaaaaagaatgtgcttttgctttttaatgtacaaatattaattcaaagtagtgtattaactcaaagtcctggtttcagcattttccatcaataaagtctatgacaaaagaaagtttctgatttaaacatgaactgcttaggcaaatggagatagcaggtgaaaatacagtaaaaataaggtggttaataattactgtaccaatgctggcagtaagattatattaatactccagactggggagtaggaagcaatgttatataatgaccaaatttcccatatatatttggaattatttagaaagagctatacagcaaaactcttcttgagttgagttcattgttggcttacctttcctgatccttcttgaatagaataataagtaaaatagttcccaaaataagccccttctgatttgaaaacagatccatccccagaataaatctctattgagttcatattttgatgggtaagtctaagaaatagaaataaccattaaaaatttttttccacttgagattaaaacatgcatgaagatagtcatcaaaaaacagtaacaacaaaatctaagcaaaacaacacagtctttttgcctgtccagtgaagcagataatttcatattctgaacccaaccagctaaattaactctttcacgaaaagataaatagaattggcttatgcatttatttcaacaactaaactaagaacttctggaattcaggcatcttgtcttatcatcttcttgatatccccactgctaatcacaaggctggcatataagggtcaccaaagcaatgtctattgcatacgtgttaaatacaacatttccagaacctgaaaatagattaatgaaactagcggaatcaatactttatggataagattagccgtctgcacaaggggctatccctaagaaaagatggctgtacctggagcagccaggtacaatcaaggtactgggtatataccaaatagaaacttaagccaagttaattttattaacatacatgttagaatatgttgttagaaggaataggtcttcacataggaaaaggagagccccctcgctctccaaaaatttagcagtgctcttctagcattgttcatggaagtgaaactctcaatctggctaacactagtattctagtcactagaagggtgtcctttgttgtggggtatggataattcaatggaacagtgctggcacagagtggccactcaatgagtatttgctttgtgaatgaaggctaaaatctcccttaggtgatctaacttctctaattccatgctcaagcaattctgttttgactatttcaaacaacttgatcctccaatgcttggaaggagtatcctaaataactgatatgaatgttacattcactagcaaaccaatccctcattggctttggaggtaccacataagtcttataaaaatggttaatgtgagtgagtcacaggacccttgtgtgcactaataacattagttttgagacctgtaaaactcaggatcaaacacaggagcacagttggcccaacagaactgtgtcctcttctgagagtctgtctataaggctcgtcccatcttctctgtgacatcaataaacagctctaactccaacatagaagccaacataggtgccttacctatatgtaacacctttgtaccaaaccattttcactagttcaggataggaatattcatcagattgtctctgtaaaagtgaatcacaaaaattccacctgtgaaggataaaatacaagctattacttctggttgctcaatataattgtctttagaagtcaacaaaatgttgctactgtaacaggattaatttcttgtttaactcactagatcaaagaataaaaattaatatgaaggtatattaatgaaatgtaaaaagcaagtctttttccatgtttttttcactattttcaataatctcattattgaatctcagcacaattacataaattaacagttttaataacatttaaaatttagcctggattcgctaggcatggtggctcatgcctgtaatcccagcactttgggaggccaaggcgggcggatcacgaggtcaggagtttgagatcagcctgaccaacatggtgaaaacccgtctctactaaaaatacaaaaattaggcgtagtggcacgtgcctgtaatcccagctactcaggaggctgaggcagaagaatcgcttgaacccgggaggcggaggttgcagtgagctgagatcgcgccagcctgggtgacagagcgagaatccatctcaaaaaaaaaaaaaaaaattactaaaatatctatagtgggccaagcactgtgctatacacactgtggatataacaaccaaaaaaatgtagacatggtctctgccctcagcagggacattaaataataaacattgagtgtaaagaagaggcaagtactgcatgctatggaattgtataggacttaacttgtttagggtcttcaggaaaaccactctaaagaagttaggtttaagctgaaacctggaaatgagcataatttagccagctgagagagaaagagaacactcctgcagagtaaagagtaggtgcagtggtcacagagtgcttgagcaagcattttagggattgctaaagtccagcttagcaagaatagagaaagcaagggcaagagtagtgagagagttgaggattacagatataggaagggaccaggtcacaaaagacctggtaagctatgtgaaggatcatggatttcaacctaaacatcatggtaagttattgaaaaatcattacttttgaagcataattcccttttgatgtgtactcgtaatacttttctcattttaaccagataatcatgacaagcctaacagtcattcccatatttttgttttaaataacaaatgtatactcagagattgcctgggatcaaatctcaattttacaagtactagctgtgtacctttcctcaagttatttaacatttctatgtcgcaagttcctctacatatagggatgatacgttttttaacttcatgggaatgctttgagaatcaaacgggtgaagtccaacagtacctggcacataagtgttttgtaagtgttagtttttatcattatgatttgcactgtttatgcaaagttgatgttacaaatctacaatccttagtggagttaaaagttttatacttagccttacagaagccactccgtgtgtaccccttttgaaaacagacgtatttatagtcagtgaaccaaagacacgggtagcctctgaagctaggtatggacaaaagaactgtgtcagatccacactccagcaagcaaggtcacgggctccagtgagcggcagcaggtgctcccctgggcccacagagccctgtgcagactcctgtcccatcatttagcatactttaataatctttttaggtacagtgaccttcactagattctaagttgctataaagcagggactgtgtcttagtcatctctgcagttactggacttagcacagtatctagtgtagagtcagccttctacattcaatgcatggacacagagtaaaaaacataagcaacacatttgctagggaaattatttactatcagttaaaagcaaaattttggatgagataaactttccttgtgaatggtatcagataaaaagaaaattatccaggttaagactggttctgataaaaagcttcatgaccaatagccattactgcattacctgtgtaggtgtgggactggacagctgagtgacagggccctgggaagaacagaaaccacttttcctctttcctctgaaatatcagaagttaaaaatctactctgagttatatgtgcatcaattttagacatattgctgattttattatgaaaatgaagtgctaaagacaaaggatatttccattcctctggacaggcagccacagaccagcactgcttgacccatgtgtatacacatgtgtgctttgtaccaggcgaaggcagctcttccctcccttcagttccatttacacaactcatcttctttaaagtttctttggatttcatgatctggcaatgaaactcattttctttattcttcagtctctgtcctggtaaatttccacgtatacagattttgccagttttttcaactagtttatcttttggggctttattatttgtttctgacaacactgcagatgagtctgacttctggctaactttacacaaaaaatgtactgtaaattcatgctgagatctgggcaggcagaggtatgcatgaccatctaaagatgttatcttcacaatgccactctccatatatatcatggtaccatctgtatcaagactgggccatctcacttctgttatgtcaatgaagatatgctgcaaggagaggggaaaagagacggtgagtattttctgttaacagtccaatttttccatatatttgatatttaagtattgtgtaagaaagctcttaaatatttgtgttttactatctacagagaatgaaaaaatggagggccagatctcagcctatatatgattttccagagaatgtttgatattgttaagattatcacccttaaaaaaaagagatgtaaaacagacacaaaatgagagaaatggtcatatttagtgttaaatgtattttggttttaaatgtacaatgaattaaacagatttgtatccctcccctcaccctgcaaaagtttactctgaaaaaaaactagaaataagggaagaccaacactatgatacattatattaaaagcaatcatagctaaaaatttttctttaagttttaaataaaaaaaaaagcaaccatagcttaaatggtacaggactaccataaaaattattgacagaacaactcagaaaattcaaaaacaaactcaatcatatcttaaaatttacatgagataacataagtttttcagagcaagagggaaaagagaaaattatttaaactagtactagaattactgaacagcatttgggaaattctgtcttgcagggttatcacatgaaccaaataaggtaacatgtaaaaagtacccatcctaggtagtacctggcacaccatacactaaaataaatttcaggaggcttagaggaaactttaaaaaagtttaattactcaaagaaaaattgattctgactaataaaagactcataacaagtaacagtgttgattgtgacttttcatataagatataaacagtagatattgcgtgagaggtttttactgaattaattttgccaagcatttagcatttcaattccatttatgtaaaatcttacgtttacacaaactattgtcaagaaagcttcctaaatttaccatgctatctatatgtacgatgttaggacactaaaattgagggctgtatttactgacagcaaagctggtttgtaaggatggtcatcaaactcctcttttagaattagactatctaataatcctgctgcagcatcagcaacaagctaggcagtttcagtgaataaagtgactcaaaagacacaatggaaaattaccattctaggctaagttacaacttataattttttatggctcctttgccacgagacaatataaaattactcagccggcaggcaagcatcttgacagcatagaaaggtagcagaaagtagttgagaaacagagtttacagagtcagatagactaggttcaaatcctgactttgccactgagaaaactgccatagacaaattaggtaaactctctaagacataatttccttgcctataaaaagaggctgccggccgggcgcggtggctcacgcctgtaatcccagcactttgggaggctgaggcgggcggatcacgaggtcaggagatcgagaccatgctggctaacatgatgaaaccccgtctctactaaaaatgcaagaaattagccgggtgtggtggcgggtgcctgtagccccagctactcgggaggctgaggcaggagaatggcgtcaacctgggaggtggaggttgcagtgagccgagatcgtgccactgcactccagccctggcgacagtgtgagactccgtctcagaaaaaaaaaaaaaaaaaagaggctgccatctagccaatatacctgttttgattggatggacatccattttgatcagtatggtgttattaaatatttctaatattgttcatagttgttggacatagtaaaccctcagtaaatgacagttattattcctaaaagtccaaacacaatactatataagcaaaataataaaggtcatacccatagttacatatttctactatacattaacaaatacgctgttactgaaaatggtcacataattacttaattttgagacctctgagaatgaaaaagtcaccaatctaaaaattctgattataatgcttggatacaaagaaaatggcaagggggatacactatgtaactttgatgttttatagcaatgtatccccaggtgtcctgaaaaggaaaaaaaggctaaatattaaattacctgtttctagttacttgtcctcaaataatactaacaaaaatgaagttaaaaaaatcaccttttttctttcagaaggtatgatggtttcagataaaaaagggcaagtagctgaagagtttcgaaaatctagggctcgctgtagttgctcctatgaaaagaaatataaaatgtaaccttaatgtaaaatgatttgaaaatcaattaaaaatgacagtacagtataatccataatactaattacttttcatattctagccacgtcaacagtattttggtattcaaagagtagttttggccaggcacggtggttcactcctgtaatcctggcataatgggaggccaagatgggaggattacttgaggccaggagtgtgagaaccagtttgtgcaacatagctagacaatgctctacaaaaaatttaaaaattagccagatgtggtagtgcacacctgtagtcctagagtaactcccttgtaaaaggaggctgaggcaggagaatcacttgagcctaggtgttcgaggctgcagtgagctatggtagtgccactgtactccagcctgggtgacagagcaagaacctgtctctaaaaaacaaaaaagttgtttacgtgatatctttacttactctgtaagtgctaatgacaaaatgtgtcctttgacgaattctttctggttgttctaaaggatgtgctgaaacaggtggtgacttttcaaataaaaattcagtgccacagggagaaagttgcaatgtggaaccatcaacatattgtacttgtactgaatcatcttcataaagtatcattcgcagttcagctgccattacaacggcaggataagatatcttctaagtcaaagactgaatgaaataggaaaaacaacagcataaatagttctcttaatgtacaaaacttttatcaaaataagtgcgtgcattttctaagaagatgacattgccattgcatttacttttgttaagaatactaactacactggataaatctgaaatgaacatccttaacaaaatgccttaattaacccctagaagtttactccaatggaggaacataaccaagaagagacaaccacaagtgataactgtctttataattttaatagcttcacttctactgaaatttaatttttgtaaattatatgcttattatttagaagcttataacttctagaagtttactccaatgcaggaacataaccaagaagaaatctaatttctttttgttttttttgtttttttttgagatggagtctcgctctgtcatccaggctagagtgcagtggtgtgatctcggctcactgtaacctctgcctctcaggttcaagtgattcttctgccttagcctcctgagtagctgggattacaggtgtgtgccaccatgcctggctaatttttgtaatttagtagagacggggttttaccatattggtcaggctggtctggaactcctgaccttgagatctgcctgcctcagcctcccaaagtgctggcattacagacatgagccactgcgcccggcctaaagaaatttaatttctataaattatatgctcattatctcattttaaatttcaaataataagcaaattccacctttatggtaagaatgcagcaaattgtttgtaatataaattccaaagacaggcagaaagtaactattaggcctatgggaaaaggaccctgaagaagaaatccaaatacctggaatcctgtctctaccctagcattaaagaaacagctctttattactactgagcaacttaatctcctattatcttggatttgtccttatttctctgcattcagtttcttcttctctacctctaaagtactatgtcttcacctatgctctccatacagcagtgacagaaggggaattaaagagttgggtttcctccctctccctctccccacggtctccctctccctctctttctacggtctccctctgatgcctagcggaagctggactgtactgctgccatctcggctcactgcaacctccctgtctgattctcctgcctcagcctgcccagtgcctgtgattgcaggcgcgcgctgccacgcctgactggttttcatatttttttggtggagacggggtttcgctgtgttggccgggctggtctccagctcctaaccgcgagtgatctgccagcctcggcctcccgaggtgccgggattgcagacagagtctcattcactcagtgctcaatggtgcccaggctggagtgcagtggcgtgatctcggctagctacaacctccacctcccagccgcctgccttggcctcccaaagtgccaagattgcagcctctgcccggacgccaccccatctgggaagtgaggagtgtctctgcctggccgcccatcatctgggatgtgaggagcccctctgcccgactgcccagtctgggaagtgaagagcacctcttcccggccgccatcccatctaggaagtgaggagcgtctctgcccggccgcccatcgtctgagatgtggggagcgcctctgccccgccgccccgtctgggatgtgaggagcgcctctgccgggccgcgaccccatctgggagatgaggagcgtctctgcccggccgccccatctgagaagtgaggagcccctctgcctggcagccgccctgtctgagaagtgaggagcccctctgcccggcagccgacccgtctgagaagtgaggagcctctccgcctggcagccgccccgtctgagaagtgaggagcccctccgcccggcagctgccctgtctggttagtgaggaccgtctctgcccggcagccgccccgtccggcagccgccccgtccgggagggaggtggggggcagccccgacccggccagccgctccgtccgggagggaggtggggggcgcctccgcccggccgccgccccaaccgggaggtggggggcgcctctgcctggccgccccttctgggaagtgaggagcccctctgcccggccgccaccccgtctgggaggtgtacccaacagctcattaagaacgggccatgatgacgatggcggttttgtcaaatagaaaaaggggaaatgtggggaaaagatagagaaatcagattgttgctgtgtccgtgtagaaagaagtagacataggagactccattttgttctgtactaagaaaaatacttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacctttgttcacctgtttatctgctgaccttccctccactattgtcctatgaccctgccaaatccccctctgtgagaaacacccaagaatgatcaactaaaaaaaaaaaaaaaaaaaagagttgggtttcattcacaccttaccatttactagctagctataagtctcaggttgttcctcatttgtaaaatgggagtagtaacaggattgttgtgtgtattaaaagagaaaacaaatatgacagtgaccagcactgtggatgctgccttgcaggcactcaagcaatcttatgaaatgtttttattcctttccaacactaaccccatccccttccacattatccccttctactaccaagatgatcaagttttacctgccagaaaaaaataacgttctatagaaaacactttcactttatccctatttcctacctataaacagctcaagtgtagtattcactcactaccaaccttctctcctatcagtcttcaattcactgcaatccagctttcacctctatctctttactgacattgtttcgcaatggtcgccaatgtcttcttatacccaatgactttagtcttcatcctactaaacctcatcaacgtgtaacagcattgtctacattcccttgcaccaaactctcttttcccctacttttctcccctaacattgggctgccacagttttcttcttcacttctacctgtttttagtttaatcattcttcttcaccattcccttaaatcaaggattcttcaagacctgaccttagtccacatttcatcccttcttaacataacactgatgtcacttttatgccccaccttgtctttttttttttttttttttttttttttttttttttttttttgagacagagtcttgctctgttgccaggctggagtagagtggcgcaatctgggctcactgcaacctctgcctcccgggttcaagtgattctcctgcctcagcctcctgagtagctgggactacaggtgcgtgccaccacgcctggctcattttttgtatttttagtagagacaggttttcaccatgttggccagaatggtctggaactccacacctcgtgatccacccgttttggcctcccaaagtgctgggattacaggcgtgagccaccgcacctggcccaccttgtctttttttaaccttaccccctttaatgtatgtaatcagctgtaggtgatatcatctgtaatcttctgaggatatgtcaggatataagtaaatatttaaccacatggtctctcctgaggagattcacacacttttaattattttctttctctagagaactaaatgtacctgacctctcacagagctttcaggtggctgcctgctagaccgctctctatgtccctgtcccatagataaatcaaactcaacataactaaaatggaacttaatcactcctaccaaaagcaggcttctgtaataccccctaattgcactttcactctcatctcttccctcaaatccagtctgcatacagtagtgcccagagggatcttttaaaatgaaaatcacatctatcacttcgtggcttaaaacccaccagtaccttccatttctacttaaaatccaaactcctaaactatggcctacaaaggccacacagtctggtcctatctacctctcccaatgtcatttctcaactctctcctacttctacagggcactttagatacattggcattttaaatgttctttaaacaagctctttcccatctttgcagttctttctgcctgccttgtcttttccttggctaatcacaaggctggttctttatcatcatcaaggtttcagcacaaatgtaactcctacaagggcccaacgaccaactaagttaaagttactcccaaacatctcccaatcatttgtcatccctcttcaagttttttcttcatagaatctatcatcaaaattgattatttacttgctttttattttctcccactaggatataaagtcaaccgaagcaggggccttatctgtcttatatgtaacagtatctctggcatctaaaacagtattaggcaaatagtaaatggcacaataaatatttgaatgatgaaaaataagtaaactgctcctcttgaatttgcaatttgaattaatggtgtctcattgttagcagccaatattctaaaacttgactttccactccatgcccctgtaacaagtcctgttgattttctgtctttggaacctgactctctctacctctttctctttttcaggccatagactctccaactcctgcaactgtctggaatttcttctctctccaatccatctctagtattgatgacataggtaactttccacaagtcacaccataccaagtgctttacatcacctgtttacgtacttatcaaatggcaatatagattacagatatatatataaacacacacgtatatatcgggtatgtctacttggtattttaggggaaaaaacgggtgctgatacatagatggaagacattttctgattccaatttgggaaaaatagtctatctttggtcaggtcttttttttaatagctttactgaggcggttttctaattttaaataatcaagcatacacaacaaacagtgtaatgactaaggttcttggcataccataggaaaccataacccggctccaacccacactgccattctcatctctacagtctcattcccgcttgcgttctcatcacccagcacattacgtcagggtatgtttaacactcaaaaatccacaagtctgttcttgacatgaatgagaatctcatttctttcaaaatgctatagtctctagttacagaaggagcctgatcaaaacaaccaccaaaagtcttccactcacagcagttcggagccgaaaagttgcggaaatgaggcccagcaacggtccctggctttgatttgccaaaatgctctggaagccgcagcgtcggcgcctgcccacgactgcttcttcaggggtttcttcagtttgacaaattaccagcgagtgatatttcttggtgaaagaaaaaaatcacaaccctagaggaataaggtggcagggagagtgttttggccaagatgcccgccacgaaacaggaaagcggagacagcgccaactgtaaccactaagagaaagcgcaaaccgcacaagaccagttcaaaaccagcgccctcagggagccgcttcagagctccgcaacagggaagacaggaagtcccgcccctccacaacaggaagggccggaagtcccgcccctccactccggaggctgccctcgctgcgttccctacgaagggcggagcaggaattggtgtaggaaggggacgggtgtttccttgttcggaatggggttggctcctctttgattttttacttctggtgacccacgcaaaagcagtcccgacctggttgtattaataataaaggctgtaaggatcagccttttgaacggtccagccgagaactaaccacagagcgcgttttagtggagtggtacttatttttaaataaggtaaaaaacgattatacttcagtaaagctgtttagaaaaaaaaaaacttggccaaagatggagaactcttcctaatttggtatcagaaaataggtcgtctatgtatctgcaccttttttccttataaagtggcaaataaatgtgtctgctatatttattgccactaaacaagtgtttatggaacactcactgtgtgtttaggcatagtggggataaagcagggaaggtggcccagttctttgcgggtgaggatcagagctagagattaactggaaagaaagaataaacaatcatttattacagttgtgagtgtttctaagataaaatacagaggtttgtgagagcatagagaggcataccttgttttattgtgcattttattgtgctttgcagatactgagtttactacaaatggaaggtttgaggcaaccttgatggagcaagtgtatgggtgccatgtttttccaacatcatgtgctcactttgtgtctctgacatattttggtaattcccacaatatttcaaactttttcattatttttgtatctgttagagtgatctgtgtgatcactgatctttgatgtcactactgtaattgttttgggggaccacagatcatgctcatacattataaaatggcgaactgaatctgttacaggtagttaggcatgagcaaggcaggagagggctctcccctgccacccacccactagaaatgttgggtgatggttcagcaattatcacatggcctctctaaaaatgaaaatttggcagcgccagggaaaggccatttcctgatggcccacacctgttaacatcaaaatgttaattgaatgcaggccccagagagaagcaacttcctgggcatgccggttaagagacaaaagtgatgaagtatgatttttctgatacactccaccggaaaaaggaagaaagcctcagatgggcatgtgtataaatccataaaatcactgtgtgtgctcacttcccaagggtaaagagggctctgagcatgcagggagcccatcctaagatcatggttaaatgcggcacttgaccttctctctctctctctccttttctttttcttttttttttgagacggagtctcactctgtcgcccaggctgcagtgcagtggcgcgatttcagctcactgcaatctccgcctcccgggttcaagcaattctctgcctcagccccctccccgagtagctgggattacaggcgcccaccaccatacccggctaatttttttgtatttttagtagagacagggtttcaccatcttggccaggctggtcttgaactcctgacctcatgatccacctgcttcagcctcccaaagttctgggattataggcgtgagccactgcacccggctggccttctctctttaaccttcacatgcccacttgggtctcttccatgcgtaccttcctttctttcctgttctaatgcctgtttaaataaacctccattcctactctggaacttgcttcagtctcttttctgctttatgtctgtcagtcaaattctttcttctctgaggaggccaggactgaagttgctatggacctgcaaggataggctgctggtaacttggggtaactcagatctcttccactagtaacaagtcgattgatatatattgtgtgtgtctggctgctgtattcactggccactctcatctctcaccctctcctagagccttcctattccttgagacacaacaatatcaaaattaggcaaagtaatacccctacagtggcttctaagtgtccaagtaaaagagggttgtatgtctctcactttaaatcataacctagaaatgcatgattaagcctgtaaggaaggcatgttgaaagctaagataggctgaaagctaagcctcttgtgtcaaacagccaagttgtgaatacaaagaaaaaattcttaaaggaaattaaaagtactactccagtgaacacatgaataataagaaaaaccaaaacagccttattactgacagggaggaagtttgaatggtctggatagaagatcaaaccagctacaacattcccttaaaccaaagcctaatccagaacaaagccctaactctcttcgattctatgaaggctgagaaaggtgagggagttgaagaaaagtttaaagctatcagtagttggttcatgaaatttaaggaaagaagccatctctgtaacataaaagggcaaggtgaagccacaagtgctgatgtagaagctgcagcaagttatccagaagatctaacgaagaccattgatgaaggtggccaaattaaacagcggatttttaatgtagatgcaacagccttctagtggaagatgtcatccaggactttcatagccagagagaaattaatgcctggtttcaaagcttcaaaggacaggctgattgtcttgtgaaggtctaatgcagctggtgacttgaagttgaaaccaatgctcatttctcatttcaaaatcctagggcccttaagaattatgttaaatctactctgcctgcactccagaaacaacagagcctggatgacagcacatctgtttagagtatgatttactgaatattttaagcccactgttgaaaatgacattcagaaaaatagatttcttttaaaatattgctacttattgacaatgcacctggtcacctaagagctctgatgacgtacaaggagattaatgttgttttcatgtctgctaacgcagcatccattctacagcctaagagtcaagaagtaattttgattttcaggtcttattatttaaacaatacatttcttgaggctatagctgacatacagagtgatgtctctaatggatctgggcaaaatcaattgaaaacctttgggaaaagattcaccattctagatgccattgagaacatttgtgcttcatgggaggaggtcaaaatatccaattaagagaagtttggaagaagtttattccaatcctcatggttgagtttgagggcttcatgtctttagtgaaagaagtgactgcagatgtgatggaaacagcaagagaactgaatgagaaggggagcctgaagatgtgactgaattgctgcaatctcctgataaaccttgaatggatgagttgcttcttttttttttgagatggagtcttgctctgtcacccaggctggagtgcagtggcacaatcttggctcagtgcaacctccgcttgctgggttcaagcaattcttctgcctcagcctcccgagtagctgggactacaggcatgcgccaccatgcccggctaattttttgtatttttggtagagacagggtttcaccatgctgtccaggctggtcttgaactcctgaccttgtgacccgcctgcctcggcctcccaaagtgctgggattacaggcgtgagccacggcgcctggcctgcgttgcttcttatggattagcaaagaaagtgatttcttgaaatggaaactactcctagtgaagatgctgagtattgttgaaatgacaataaaggattttgaatattacataaactttgttgataaaacagcagcagggtttaagatgattgactcaaatttttaaagaagttctattgtggttaaaatgctatcacacagcattgcaaactggataaatctttcttgaaaggaagaggcaaacctcattgttggcttattttaagaaattgccacagctgtcccagccttcggcaaccaccacccgaatcagtcaacagctatcaacactggggcaagaccctccaccagcaaaaagattacgattcactgaagactcatatgatcatttgtattttctagcaataaagaatttttaaattaaggtatgtatatttaaagaatatgctttcgcacacttaataggcctcagtatagtataaacataacttttatatgtactgggaaaccaaagaattcccaacttactttattgcaatatttgctttattgtagtctggaacggaactagcaatatctccatggaatacctgtaatgagcagatttaacctaagatgagaaaatatttccactgaagtttgaaatttaagtacgtgttagccaggtaaagtagggggaaaagtatttcaagcagaggttaaagtccctgtgttaaggctgtgaggcccaagggaaggagctttccctttaaaaaggactgaaagaaagcaaatgtggtttaagcatggttagggaggaaagaggcctgaaggggagggaatcctggagtgggatacagaggtaggcaggcagagtacagaacattagggatttatggactcaagatttatattctctgacaccaaattaggaaaaaaagaggtctctatttttggccaagttgtgtgtgtgtgtgtgtgtgtgtgtgtgtgtgtgtgtgttttaaacagctttattgaggtataattgtttattacaaggtgtttaagtaggctgggcacggtggctcacatctgtaatcccagcactttgggaggccaaggcaggtggaccacctgaggtcagtagttccagaccagcctggccaacatggtgaaaccccatctctactaaaaatacaaaaattagctgagcatggtgccaggcacctgtaatcccagcgactcaggaggctgaggcaggagaattgcttgaacctgggagggggaggttgcaatgagccaagatcgtgccactgcactccagcctgaacaacagagcaagactccatctcaaaaacaaaaacaaaaacagaaaacaacaaggtgtttaagcaaatgtggcagcaccacaggatggggggggcaacataaacccctaatttacctccatttaaaaaaggctgatatgcaaattgatatcaatcttccatgaagtgtaaataaaggcatctttaaagatcacattttcattgacctgtaacatcagtttgtatcacataatgctaacttagttcctgtcccacccccaccttttaccttctaagaacctcctatatcgaaatcctatctactacagagttttgtgatgctatttgtccattagaaagattcttggaactgctaagtggagaaaggattataggatgcaaggttgatgtggatagctcagtagaaggtttttgaaaaagcaacagtagagatcatggcagcttggacgcaggacctgggcagtgaagatgatgagcacagctccaggaaatatttaggagattgactgtatacttgatggtggttgaacctggggctaagggaggggtaggagtcataggcaatcagggtttctggttgggacaagtggataggtggcagtgctactgataagaaaggggatgttaagaggaagagcaaatttactgatagcatgatttaaattttgttagtccacctgatcgaaatggtaaattagtagaggtctgcaatcaggagatagaaacaaatctggaggtcactggctgatagctgctaactgaagctacaggagaggatgaaatagtccaagaatattgtgacatgagaaaagaatgtttaggactgaactttgaagaacactagtatgtacagattaggtaaaggaagagaagcccacaaaaacattgaggaggaacagcatgaagatggaaagcaagttaactgtgtcctaaatgcctagaggttttctttttcttttttttttttttgagacagagtctcactctgtcacgcaggctggagtgcagtggtgcaatctgggttcactacaagctccgcctcccaggttcacgccattctcctgcctcagcttcctgagtagctgggactacaggcgcccaccaccacgccaggctaattttttgtatttttagtagagatggggtttcaccgtcttagccaggatggtctcgatctcctgaccttgtgatccgcccgcctcggcctcccaaagtgctgggattacaggcatgagccaccgcgcccagcctgaggttttcaattttagtgtcacttaacaatgtcacatattgagaaaatttatttgttgcttccctcttccctctcccctctcccctctccccacggtctccctctctttccacggtctccctctgatgccgagccgaagctggactgtactgctgccatctcggctcactgcaacctccctgcctgattctcctgcctcagcctgccgagtgcctgcgattgcaggagcgcgccgccacgcctgactggttttcgtatttttttggtggagaaggggtttcgctgtgttggccgggctggtctccagctcctaaccgcgagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcctcgccaccaccccgtttgggaagtgaggagcgtctctgcctggccacccatcgtctgggacgtgaggagcccctctgcctggctgcccagtctggaaagtgaggagcgtctctgcccggccgccatcccatctaggaagtgaggagcgcctcttcccggcctcccatcgtctgagatgtggggagcgcctctgccccgctgccccgtctgggatgtgaggagcgcctctacccggccgcgaccccgtctgggaggtgaggagcgtctctgcccggctgccccgtctgagaagtgaggagtccctccgcccggcagctgccccgtctgagaagtgaggagcccctccgtccggcagccgccccgtctgggaagtgaggagcccctccgcccggcagccaccccgtctgggagggaggtgggggtcagccccccacccggccagccgccccgcccgggaggtgaggggcgcctctgcccggctgcccctactgggaagtgaggagcccctctgcccagccagccgccccgtccgggagggaggtgggggggtcagccccccgcccggccagctgccccgtccgggaggtgaggggcgcctctgcccggccgcccctactgggaagtgaggagcccctctacccggccaccaccccgtctgggaggtgtatcgaacagctcattgagaacaggccatgatgacaatggcggttttgtggaatacaaaggggggaaaggtggggaaaagattgagaaatcggatggttgccgcgtctgtgtagaaagaggtagacatgggagacttttcattttgttctgtactaagaaaaattcttatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccactccctaacctcaaggacccagggacacaaacattgcggaaggccgcagggtcctctgcctaggaaagccatagacctttgttcacttgtttatctgctgaccttccctccactattgtcctatgaccctgccaaatccccctctgcgagaaacacccaagaatgatcaataaaaaataaaaaaataataaaaaaaaaagaaaaaaaagaaaaaaacaatgtcacatattgccacaggataagctaaggatgaaatctctccaggacttagtgtcatagaggtcattggtgactctagtgagggccactgtatatagtgggggcaggagccatagtgggttttaagctcaaataggaggtaaggacatggaaaacatgggaaggcacttgagaagtctgactatgaagcagagataggactgtggtcagatacaaatatgagaagcagatttcttctgatgagaatggtgtgttcaactgtccatgcaaagagccaatggagaaagagaggaaaaatacagaccaagtaacaacagactccatgagagaacgagaggagataggattgcagcacatgttgaataactggcctttaataagaggagggattcttcctgtacaggaagaggagggatgaagtgaatgcagatgcatttgtgtacatgggtatcatggtttttttttcccctgtgaagtaatcagttagggggtgaaaggggctttagagggaaaggggtttgaaatagttacagaaggattgaagagaaacacattaacattgttggcagtactgacagcctaactcaatgtgctgagcatgaatttacagtgataaaaatctaccagaaacgacctccagctgcaaggatgcagaagcagtgttgggttcatccagggctggtattttgccaggctgacacaatagagcagcagcatacatgagcttaaattatttacatctgctgaagtctagtccgccaaagatcaccaggctcaagcctgtcttctgacaaaaccatttattgatttgcaagcaagggaaccagaagcagcaaagatggtgcattccacaagagggcagggggtgccatctttggtaaggtttgggttcccagtgtagggttctgagcaagctataagggaaaggagaccagttctgggttggatgctatttctgtagcaagattagatgtgagaattaactagagattggtgctgcaatgaggtgagggcaagtttagcaactggatatccccagtagtagatgggttatagcaaaataggtctaagggtgtcacagccaacaaagcagtggtcacatgagggagtcatgatggtattttatagctgctgcaggacctaacagtttcatgttaactttgcagctgccttgcctgtccccctgacagtggtggagctttttttttcagtttgagccactttgagtcctagagtttactttcataccaaacatcctcctctcattaaatgtgaatgatttttccccctaaagtacaacttaatccatatgcatctgtcctctctaaagatttaatgaaatacctaattatagaattaagcttgctttctggcaagacccagcctagagtgaacgttaagttttagaccatcccctaaatcaccaaagcccaaatcctaccacagattctaacacactcttactgatgcaccccacaactcccacaaggtgtatgttctcctttactgcaacaataagctcaggccgggcgaggtggctcacgcctgtaatcccagcactttgggaggccgaggtgggcagatcatctgagattgggagcttgaggccaacctggccaacatggcgaaaccccgtctctactaaaaatacaaaattagccgggcatggtggtgcgtgcctgtaatcccagctacttgggaggctgaggcagaattgcttgaacccgggaggcagaggttgaggtgagctgagatcacgccactgcactccagcctgggcaacaagaacaatactctgcctcaaaaaacaaacaaacaaacaaaaaaaaaaacaaaacccagtaagctcaacatgttcaggtacagtgtgttcctggtagtctatggctggagagcattaacaacataaagacagagggtcagagttgatgacaacttctaggttaagaccaatatttgtggttttttttttttttttgccagaacgcaagactatatttactagcagctctgtgtccttgctcattggaaaatgatctttcctcaagacttgctgacacgtttctgtttaaggcatgacaatcctaaaggccaacaattgtggacgggggcaactcttcctttcattatgtactggtgtagtcaattatgcaaagtctggtcaaccaaagaccaccaggctcaagccatcagttttaaaatatggccacatgctccttgatggcctatgtgatatggctttagtaactcccttaggaccaagagaatataatggaactaatgctgtgtaacttccaaatgcagctgctttctgggtcttttgaaatggcccttcagaatccaggcaacatgctgtgagaagttcaagctacatggacaagtgtagatggttctggtgaacgattccaatctagtcttggctttaaaagtcatctcagtaccatgaattcagatgattatagctctcagatattcaaattaccctcagcccttagttttccttgcctaggcctcagacatcatagaataaagccatccccattgtgccctctccaagttcctgaactatagagtccatgagcataataaaatgattgttttaagatgctagatttctgtgctttttttattaagcataataccgggaacagatattgatcttgtcggtagctactgtgagtagagcagtagttggtgacaatgagctagtagacaaatactggacagttattcacagagcagctgctagaagtttcaagtatatgcagttagcattccttgtccctggtctaatgtaccatctcttctctacacctcctctccctccaatatttatagtcagtgctatctttagagaactgcagattatgttaatagctgccatgttacaggagccattttgaaaaacatttcttactacaacttccaaaaaccacaattacgtacattatttcctttatagaaggaattttaaagttttaatgttttatatttgctagtttttcaaggtagacttgttactgaattcttattcagagaatgaataaaatatcttctaatatgatttctttgatttcaaaccattaagtaaattaattatgtcatttaagttcaacagcaaattatttaaaataccagatgctacttcaaaaatttagaggaaacaactatttaagctttattttcaaagtctaattttaattcagactgaacaaacaagcagaaaagtgagaaagctaactgtattagcagacacagatgtaccaaatgtaaaacagtgggttattaacagaactatttacatgcatatttacaagcaatccttttgtacacagtttttagttagctggaaaaagatttgacattaggtaaaaatattatttattagggctgaggtggtaccacattatagtaaaagtattagaaaagtgaccctcaaggtgtatcaattataaagcagatgaaaacttgaatgacaaatatctagtaaaattctctagtaaaaaagtcgatgcaacccatgctacaaaataaaagtgagaaagccatataaataaagcagaataatgttctagcctttaaggtaatgaagttagtcagttgaaaaaataaaaataaaaaagaacaattctagaattggaataaatcttcagtgaagtcttggttgtttagctgggagttcaccaagttgggtttttcccccccatgacatttaaaaagcccttggtatcaaatagcatctgcatatgtaaatcagttgttgatatattccaagactttagtgctaaagattttcaagattatgattcatatttgaaattcaattcattgggacactaaatgtcaaactaaaatgaaagctataatactcctacctaaaaaaggatgctacatttttgcagtaatatgtatttccagaagaagactttttcccctcaagaaaagtagaatttaaaggataagcatctaaccaactagcaaaattttcaacatttcatttatttcaaaatcgattttattgcagccaaaacagtagaattaactgtacataataaactattatatatatatacacattttaagttatagggaataaagtttattttggcagatagtgttaaacaaaattaaagttgcatacattagtaacataactcaacatccttaatttggtatagatgtgacattttcttgctctcttgtgttctgctaaatcaccatacctaaactgctttataaaactgatatgctgaaatttaactttactgttttcgcttacgctctgattccaaacaaaacttttcataagcttcttctatctctgggtccatctcatcatcaatatcatccaagtatctgtaaaagcaaagatgattcataagtgtaaggtttttcaactcagaaagtaagatgctaaatcatgaaaaaaataatgtaatacaactttcctagactgacttataatagaacacaagcctaactttagaattacattaatggcagtcttcggacaaccaaatgcttaatttggtaagtaaaattttacagattctgagtcccttgtgtgtgaaattatagtaaagaatatatatacttttagacataagttaaattctataacctgaaagttaatcaaaggcttgacatataaacttggggctcaagatcgatattaataaatttaccttaccaacaaacaattagaatataactattaatagaacataatttcaaatatgccattcacctctagtgatgcactaatattttgtgtctacttaataacagaaagtgctattcctgctatgatttctgctgggttattcccatgatgacaatttagtcacattcccatttatttggaatcagattttcacaggaagctacttttgagatcatctattccagatttttttccaactattaggtagtttaaaatggtggaaagcaaggcttcccatagttaagtatggcgggaaagatttaaagtgtcaattaaggatttaatctacacattcttactgaatgtccatagccatcttaaaaagatatgcattacgatcatcttcattttggagatggaaaataaagagattctggaaggttaaatgaacaatgtaaaattttaagtgtgtggcggggccagaatttgactccaggtcttaccccttttcctccataacatgattctatcaacatcttccccacccctccaataatccaatcccttccacctacaagcatgaaaaaacaatcttgccaaccctaccaactgctgatgagtccttttctgtttcttccccatttccaatacagggccatgtgttgaaataaccatgagctcattagggcaagagaatatgatgcttaccaaataaacttaagaggataacctgaagttcaatgccaagaacaactttatcttccagcggtatacccaagtagatggaactttcctagttctgcctgggtccttaaatccctgtattttttttgttttctattaaactagaatatagaagtacagcaacaattgtatttctagatctcaaaccgacacataattaaaatatcactagaataaaagtggttcacttttttaaaaaaatctacaacacaggagatattaaaaaaaaaataagttcaagatataatttattccctcccatctcctacttaggaagaaaagaaactaagtagcctgtccaaatatacacaagttgttaacagaattggtactaaacctcacaatttcctggtccttctataagaaaatgtagtgcactctgatggtaagtgagtaatatgtttaaagggatctttaattacaaagagtggcaggtgaagaaacagatatataaacagtcctataattaacatcttcttatcagttcaaacatttttacatagtaatctgttttctttactcttaacttaccctttaatagctaagatttgagccttctactgtgtgccggaaggctaagtatttatgtattctcatgtagttctcaagaaaaaaaaaaaaaagactcaacaggtactactattcttattttatagatggagaagcagaacagaagttgcccaagatcttacagtaagttttagagcttcttaaagtctaaatacaatagaatctattttaaaaaaataattatgcttaagtatactatattttaatggttattttcctcaactatacatttttcagaactagtctgtgagttaatacaattttctgaaaatttttagtacataaacactaccacatagcaccatcaaatcaaaatgccttttttttttttgagacagaatctagttatgtctcccaagctggagtgcagtggcacgatctcggctcactgcaacctctgccttccaagttcaagcaattcttgtgcctcagcctcccgagtagctgtgattctgtgatcctggctaatttttgtacttttagtagagacagggtttcgccatgttggccaggctggtcttgaactcttggcctcaagtgatctgccctcctcagcctcccaaagtgttgggattacaggcacgagccactgcgcctggccccaaacaccattccttcatgagctactttgtctaatctccacctataaattagacacagaaatttcacgaagttagtaactgaagaaaacttacggatcaccagccccggataaatctgttccattttcttcataatctggaaaaaagtcctctctttcaagtaattcttggtatttctcttggtaatctgtaagacaacataggagaaaaactaaatactgaaaaaatatcacatgaaatgaccaatcacccctaaatgttttttaatattatgacttttgcccccctgcatgctcagaaatcttaaagtaattacatatagtactatagatataagttggaaatcaaagccactgtaggtgatgtacattcatagccaatgtgtttatatcctctactgctgctttccatcagacaaaataatggttatataactgttggggaagaacagtccttccattggaaagatattaatcaaatactactggtttccagctccctctgtactcctccacaaggaagtaaagaaagcaggtaacaacaattggtctctgttcctcagatgaagttaacctaccaaaagttttaacaatgggggattttccttccctttcttcccagagagatggggaaggcagctacctggtaaacgtttcagctctgccaactttcctttcattgggtcctccaaggtaatacaggtgatattacacctatctgccaattgtcttaggaagagttattgggtaccttttaagttaagtatttctttatgaagtcctaacctctgaataaaaaaatgaatcagtatatattaagactagttaccttatagtttcttatgaacagaagccaacggaaattttgcaattatattagactgggtaaaagccatgttcttccaagactgtgtcagtctgtataaaaccgtaactccagcttcaagggctggggacattttgatacccaattttgacaatttagagaccgttttaacagtaaaaccttcctgctacaaaaagacaggcattcttttaaatgtatggataagttcacaaaaaagaaaatccaagtcatcaggtcacaaatgaagaaggaactgaaagccatatataaactgcagctgctgcagctgggaggctgacagatgatgttggtctcggtaactaaggggcttggattttaaaacccacagaaagccagaaagcaaggtcttgggccccatgtgaaacaggaaaatgaaatccatgctccatgcccaacctcacctgcacaaacctgggaccctcaaaggtctggtatcttaaacaaaaggtgaatcaggaaaaaagaccaagaaatatctcagtggtattttatcttccctgcgagatagcaggaagcttggtcatgtctgcctgggtttggaatagggacagagcactttgtagaaattggtgccccagagaatttttaacaatgggcctgcacctcaaattcctactacccacataaagaacccctatgacaagaaaacaaaaaatttgtccaagtcagtgatacctactctgtggctcctggcagaaggaaatataaaccattttggacagaggttcctataatccaagccacagtgtttttcattaaaaaaaaaatgaaaaaagaaaaaagaaaaaagacaaagcactgaagcatttaatcagggtcatattaatatgaaacttcaaatggtttaagaaaaaaaaaaaaagtgtgtggacaaggtcaggaagtcaagaccagcctgaccaacatggtgaaaccctgtctcaataaaaaaaaaaaaaaaatacaaaattagccaggcgtggtggcacaggcctgtaatcccagctacttgggaggctgaggcaggagaattgcttgaactcaggaggtggaggttgcagtaagccgaggttgcatcaccgcaccccagcctgggtaacagagtgagactctgtctcaaaaaaaaaaaaaaaaaaaaagagaaaaaaagaaaagtgtgtggaaagagcacaaatgataaagcaagtaactgttaacaaaaagtacacctgggtaaaaggtattccttgtacaattttacttttgtaacttttctgtaagtttgaaatcatttccaaataaaagtttaagacggttaaggcaaaaattttatgtgtgatgatcagaaataacagaagggttataattaagagataaaacaaaaatataagacagaagtaagcatgtttagaatgatgagaaaaaataacttgaaactctgagaaaaggtcaagattatttgaacaaaatgcagaaacaaaatttagcttgatttttctgtaaaactgtaagatttcttttactttcatgaagtatagcagattaaaaaacgtttaagaaaaagaaactgagatctactggctgtctacattacttcttttccttgaaaagaaactgaacaaccaaactgaatttctgtaaatcgaacagtactagaaacaattaaacaggttagaaaaaataaaaaacaaataatcaaaataaatcaaggtaatttttaagaataagaggaaagatttgtcttaccagacatagcaagattcacagtaaggtaaaaataatttaagtgtagtattggcatagaaagagattaacagaaaaaaagattcacacaaacacaggaataagacacaatttgatagaagagttacatagtatacaacaaagggggcttattataactaggaaaggaaggatggcttaataccaattgttgagacaacaggcaatggaaaagataattcctatgatatcatcctatataaaaattgcactggtagattaaagacctaaaaataaaaaagaacaatgatttttagaagaaaacagaaatggtaaggaaactttcttaaaccacagaaattacaaacaagactgataaattttgttcacattaaaactcaaaggttctacatgacattataaacaaaatgcaaagacaggcaaatactgagagaaagaaggtaaccaaaaccctcagctaagaatcactttgttctagactacaaaaggaattacagatcagtaagacagacaaatgatccaacagaaatatgaacaaagagtattagcaggcaattctcaaagaaagaaatcaaaaaggtcaacaagaacaagaaaacttcaatatcacttgtcagggaaataaaatatcagcaagatagaatttcatacaatctgatggacaaaaattaagtttaataaaaagtattgccaaagatgaggagcaggaaccctcatgtgctgctgatgggaagattaagtggcataatcatgctagaaaacaatttagtaacatttagtgaagtttaagatgcccatagcgtgtaacttaattctacttccttgccctaaaaaaacttctctgtgctagagacacaggacagtcaatgcttggaatccagaggaaacaaatggaaaaattccaaccataagctggttgcagtttgtaccaaagggaaaaatttctcttcctcactctacagttccatctaatacaattaaggcaatctttctataaatggtcctcttctggaagaggaaatgtgcagagatttggattttaattaactgtcacacaccaagtatgaatgaaatgtgtaattcttcgtgtaaagtattaacccatattaatatatgttgctgactatgcagtgaactagaatcgtctttcccctccattctaatcacctgaaaatttaagattataaaaaagttagaggaaatataaaattaaaatagttgcatttaattgagaattcttcccatcctctgttgttaagtgacaagacattatatgtggaatcatactttcatttgaaatgtttcaagtggtcactatgaagagcattctatattagacaaaccattacactggtattttagaatgatgtgaagacatcaaaaagttacaatcttgtgctggtgaggatgtggttttctgtaaatttactactttaccaaacaactgggaggagggaatgactgtgagacaacatacctggatcagctgcagtgaaaggaacaccatcagatgtataaaatgttggttcattctaggatgaatcaaagtgataaaaatatgtaatcatttcagaattgatttttgtaagtacaataatgaagcatggctgatgtcacccgtctgcacctaataatgcaagaacaagcaaaggaacctaacttcctggtagccattttcacttcactgagaaagtctatggttttcagatttccatgccattatctcaagttcttgtggttctaacggtgctgtctattgtctttcagtgaactgttctgttgtgcattgtcatttagtgtcagtgcatttttagctgtggtttccaaccccaccatttcttttaagaatttccaggaccagggctggaggaacatttctccacagctgctttatgtttgttcatgtcaggagcttcagggcatcactggcctagtagccattttttttttttccctgagacagagttgtgctcttgttgcctgggctggagtgcaatggcgtgatttcagctcaccacaacctctgcctccaggcttcaagcaattctcctgcctcagcctcccgagtagctgggattacaggcaagtactgccacgcccagctgactttgtagttttagtagagacggggtttctccacgttggtcaggctggtcttgaactcctgacctcaggtgatctgcccaccttggcctcccaaagcgctgggattacaggtgtgagccactacgcccagccaaccaattttattttatttttcgttactacaacatgcaaagtaaaagtctgagatgcaggtccttggttataaattctctggaaaagctgcttcctggcatccctgtgctcacttaagtccaagccttgtcaatctctcttgccattggatatatctttctctagtccaccctttcactggagaattccaggtctcttttcttttttacccagtctgatggctgccatgtcactcaaagccagtgaagacagttattaggcactgaattctgagaacagctttatgtagctcttctaatttccaaaacggaattcaagcaataagtaaaacttaaaatataaacactggcataccataaagtagttaggatcattttctggtgttgcttctctatatgttgaagttgcatggactctgccccagttacttgaccggagttctacaagcttcaagagcatctgttttacatctctgtagacaaagttgaaaatgagttagtgtatccaccataagggctgtcagaccctaaaatatctcagattcccaaaactttatttccttaatttaacaggtacatctgatgccttgactttctagacgtttcctatatgacataaattcatttaaaaaaaaaatagccttgaattatgttccacgtaactatgactatatggaccttaaaggcagtggctatccttcaaacatttttatgtgtcctactatacttacagtagtacttttatttgttggacagttaatatttggattttgtttttcatttaattcatatcttaagaaaattagctttttcaatttctaaatgtaattgagcaaaaatatctgacacgtctatcacaaaaatgtctagtgagcagaaactataggtaaaatattattcctttaaagaaaagcatttttgtatatccgttagccatcaacttaccctgctgaagtatagcaaattaaaaaacaatctccaaagaaaaagcaagaaattgagatgcactggctatttacattacttcttttcctacctactgcagtttgcatctaggacaacgttttcaattctctgaataatttcttccatatccatctttcctttttccttccaagcatcttccaaaactgatcctgtcaactaaaaaagcaggtgtcagtaaaataagaaattcaatagtgtattatagaaattctaaaaagataccagtaacagttcaagcattctctaaacaagatgaatttagcaagtttaatattcctaattattctgtctaccatctaatattcagtgatctctacgccctctatatttctcttgactgagagaaactaaaacaaaaaaaacaatagcagaactttaatcatgggttttatgtcaacgactgttatattccctgtatgactaagataggctattagattttaatgaacatgtcactttttttgaaatatacagcaagcaacaagtatagaagctttgaataaaaaaaaaaaacacaaacatgcatttcatcaggaaataaatcagttaaggatttaaacaggtaatttataggaaataataaacaaatggctaataaacatgaagaaatgcttaaaatcatctgacaaaacaaaaaccaagattgattatatccatcactataaggatgtaggaagagatgtactcattctgctgatggggctatactctggttcagcatttggaaggcaaattagccattacttgtcgtaaaatacatatgctcgtccacccaccaaatccgtgtttaagaatttaacctacaaaagtatctgcacatatatatgacaagaggaaagattacaagcaatgctgccatggctaaactgaagataatccaaatattcattagtaaacattgatagatgttacggaatggataaacaatgcatatgcatatgacagaatactaggaagttattcaataaaagaggtaaatctctgtgccatggaaaaatctaagatgtttcattaggtggcaaaaacaaaaacaaaaagccagaacagagtaagatcttatttaataagagcacatatacagagataagaagggaagaagacagaatttgcaaatggaaatggcgtaaaggacttccatttttcacttctgaacttgcttcatatattaaacaataagtatatctcgcttttccaaaatattcgagaaaaaagtaaaatgtcaatatttaccttaaagtgataaatcttgaattcatctgtatactatatagactaaccttcctctaaatcataagtaaatacgtaaattagttaaattaaaaaaaaaaacctacctttaacaattttactgcacaaattaaattgtcatccataggattagaaaacagggcattcagcaattctcgaagaccaacctgaagaatatctgctcttgtaacctgtccatttgttcccttgatctttcgggaccaaaaaaaagaacaaaaggaatgatgccaaaatataatacagatacataaatgaactaacaaggtgttggcaaaataagcattttagctaaatcacaaaagtcacaggaacacactctgatatcttcacagaatttgttagaattactttatatgtaactaagacctctaataaaactggtaagctatgggtaaaatttaataccagagtcagcataatttaagcccactttgatgttactacttcataaagctttctttagtttgttcaactaccacttttttttgaacacacagcattttattctgcttttaaaatattttaaaatatggtattttgcatcagagtggtatatgtatcttatatcactgtgtagaagaattttaggtgcaggaactaagccttatctttacatcccccattgacctagcatcattatctccatatagaaaatgctcaacagtatttattttagattgctgtccatattttggcttaaacaaaaattagactgaaaaagaacatggcataagatttttcaaaaaactaagtctacctgtggtaaaaaggcatagtaagttaggctctggactggacatagaccttttagatacaatgactgagatgcacatttgatagattcacattgtcttatgatgtttctgatattatggcgtttacgatcttaagttctcaaatcagggtgtaagaaggtataagcttatatctgatattcactaatttaaaaaatcaagcagaggctgggcatggtggctcatgcctgtaatcccagcactctgggaggctgaggcgggtagcacctgaggtcaggagtttgagaccagcgtggccaacatggtgaaaccccatctctgctaaaaatataaacattagccaggcatagtggtacgtgcctgtaatcccagctgctcagaaggctgaagcaggagaatcgcttgaacccgggaggcggaggttgtagtgagccgagatcacgtcactgcactccagcctgggtgacagagcgagactgtccccacccaaaaaaaaaaaaaaaaaaaaaaaatcaagcaaatctattacacagtaataatgccgtgctgaatccagcacttctattgcctactaacaagcatatacttaagtataccacccaaatttataaatacgtttagctgtagactttgtacaaatgcatttttatgtggaagattaatatataaaataggacaaaaaagaactattcttaggggttggggtattggggagatgttggtcaaaggacacagaatttcatttagggggaataagttcaagagatctcttgtacaccatgatgactatagttaacaatatattgtatacatgaaaactgctaaaaattttaagtgttcttaacacaaaaaagtatgtcaagtaatgcatatgttaaatagcttgatttagccattctacgatgtatgcatatatcaaagtgttgtgtaccataaagatataatttttgtcaattaaaaaaatatttttaaaaaactatttgggtgaattagagtgaaaagcctagagagactctagtctctcttttcactcagagttctgcagagtaaactgctttgagccaccatctgaaagtcaacatactaaatgtattaatatataagatgtaagaactcaaaaaggtatcactgttgatatctcaagaacttaaatttgcatgtaaaccacagcttcctaaaagtacgcagatttttacctcagtaattatttcctaacattctgtccatgagtaaatgttatggacagacggtccagtaaaccacagacactagcaggtgccgaaacatgttttctttcctctctctttcatttcactcttaatgttgtaaaagtacaatgtgaacacaaattcctcattgagatcaacttatgttctcaggccttgttagtacttaacaaaagaaaaacttctcacctccaggttaagataaagttctcccagaaagagtacaaatgcatgaaatcgttttcgagtaacttcatccccttttgcagcttgatctttaacttcatattcagtccgacatctaattaaagacatatcttttataatctcacattgctttgctttttaaatagtcaaacaaaataaccatttgtcagtttggttgtccacagcaagaggcaaggacaatgtcccaatgctctttctacaataaagaaactgttcctgactattgaagaggctagaatatacaccatcttttcatactaagtctcccagtttgaaaaaactgatagttttattttcaacgatttttatcaaatttaatatgtttaagcaacataggtgtaatctgattcacagcatactggcagcccaaagaggggagagagagcctcaccttgtcttataggttttttactaagaaagcactgattttacccaaattgtctctgtaattttttttttaatactacaactttgaaaaggatctttaaatacacacacacacacacacacacacacacacacacaacctccaactgaaaataaaatgaattgtttttaagtccattattcttgtaatttccattatacgtatcagagaagtactaatgtgaggaaaaaattcccccattaaaaccacaatatagaaagcaccggacttgttttctatttccaatgagactgacagcttcaaataactgatttttccttgctctctttgcccctgacttgacccatttgcttcacacagaggagaaaaagaagaaatcctcttcttggagcttattgtcagtcatagttcctacaaggtaactaaactaggcacaataatcctgtcactgccttcataagtgaactacagtgtcagatattgttactaacatagattttttaaatggactgtaaaagtttatcattttgttattaagtatttgtaatctttattgataaggtgagaaaactctgggaaagtaacttgcttcacaaaactggttttgacagttttccttttcaagacaaagggaaaagctatgggtactgaatggtttccacgcagccagtttaggttgactttgtaaacaatttttaacaaagaaaaaataaattacctcttgttcagtaattgactctgggtcagtttgccaaccacgaaaccccagcacagcttactgtgcttacgtggccaattccaatgtttacgaggtatattaactgagcaacatcttctgtttaagtcaaatgtggtaagatatttgttatcatcttgtacatattaaattcctcatcagaaaaaagttgggatatttatagatagtacattctggttaataatggaagagatcagttaattaatgccaaatcagttatttaaaaacacctgttggctgcttttctgttacaactttgtcggtaagagttgatgaaataactttttttttcataaaatgctatgacagactgtacgttaggatatgattatgtacatgcaaacaaatacctacataattgactaggtgaaaagtcaaatttttaagctaaagattttcaattataaaagcaatgtatgtttattttggaaaggttaaaacagaaaaagtataaagaacaaagtcacctgcactactactaaaaacaagagataactgctgtgaaggtaacttccgttccatctttttcaaagtatgtatatattttttaaagaggtagcagaattatgctttgctttttacttgttagctcactagtatttctctacattattattgacaggattacagtactacagaagcacatatggtgggtaacagtcaatgagaagagtgggtctcaatcatagctatacagtagaatcacttgggaagctttaaaaaaccatgtcctagctccacctcgtctaattacaccagaatttcaaagggttcagacaggatctcggctttaagtatctaggtaactctaaggcacagccgggggtgagaagcactgaaaaatatgagtgagcattcctggcgtcctaccgcctacaagtacccactctgaatctttacagaagctataatttgtgtttctttaattataagtatggttagatatctttttataactttgacatttgtatttttccaaactgtatctatatctatttggcgctattccaagtattttcattattattattatttttgatacggagtctggctgtcacccaggctggagtgcagtggcgcgatctctgctcactgcaagctccgcctcccgggttcacgccattctcctgcctcagcctcccaagtagctgggactaaaggtacccgccaccacgcccagcttttttttttttttttgtatttttagggtttttttttgttattttagtaaagatgaggtttcaccatgttagccaggatggcctcaatctcctgaactcgtgagccgcccacctcagcctcccaaagtactgggattacaggcatgagccactgtgccccacctatcatttcacttttaataagtctctgacatatttgggatttcagcacagagagtgagatgggaactcatctttttttcccaaatgactatccagttatgctaccagcacaatttatcctttttatcaaaagcttgaattttcaagggtctctggggtctacttctagaatctttattctgttccactgcagtttaaccacacaatggaatgctttgcaatcattaaaagtcacttaaaaaactaatggacgaactataataaacttgaagataaccttgttactgaagacatcaaattataagaaaactagttttctctaaattagcttataaattgagtattatctccaaaatatctaacatactagcaagacttgtgtaatttcaaacactgattctaaagttcattagacgaaacaagcatagcaaagaatatttgacaggctgggcgtggtggctcacgcctgtaatcccagcactttgggaggctgaggtgggcggatcacttgaggtcaggagttcgagaccagcctggccaacatggtgaaccccatctctactaaaaatacaaaaattagctgggcatggtggtacgcacccatcatcccagctactggggaggctgaggcacgagaatcgcttgagcctcagaggtagaggttgcagtgagccaagactgagccactgcactccagcctgggtgacagagcaagactcggtctcggaaaaaaaaaaaaaaatcccacaaaagaacaaaaaactaattaccctaagatatttttaaaaatgatagcttttggcagtgcagggtggctcatgcctgtaatcccagcactttgggaggctgaggtgggtggatcacatgagatcaggagtttgagaccagcctagccaacatggtgaaacccgtctctactaaaaatacaaaaattagccgggcatggtggcgggtgcctgtagtcccagctactgggtaggctgaggcaggaaaatcacttgaacctgtgggaggcagaggttgcagtgagccaagagcgtgccgctgcactccagcctgggagacaaagtgagactccatctcaaaaaaaaaaaaaaaaagctttttaatagctattgtatgaattgtatggtaataaaaaggaacagaataagtgataaatggaatgaaaatccagaatcaaaacccaaataatgcaagtgtgataaaagtggcaattcaaatcaataaggaaaaatggattattcacttttattctaatctaaataaaattagatccttattcaaaccaaagctaccaaagtaataagaattacataagtgtttatttttaagatcttggaaaaggaaagatctttctaaacacaaaaccaaattcacagaccattacagaaaaaagactggtatactgaactataaacttcaaatataatgcacataagaataggctgccctattctttcctgcagctttttataatatatggtctgaggaatggtcaaattctagtatatttagaagtagttttcctttaatttcacatttacactgacctttgaagtagcaattggcggaagttgccactctgtgggctaattgtcagatgatgggacaggtaattacacaggcgagctcccatataagagaaatttgggatagatgtggccttttaaaaagaagaaaagtgttatatgacataggtacatcattattaatgtaaatacttaacagcaacattctaaagaagaaaaaattgactccccaaactgaccatatatacaagtcttttgtcattgttaggcttaaggaaattaaattcactttccctcccaaccttacagcaagaaccacaataagtacaaaaaaaaaaaaaaaaagaaaaaacccatcagttacctgaggctaccagaaagcgaagagataatgtctcctgatgctaacccattttttgcagaaaacctgtacatgtcctcaactgcacagtgacaattatgaatgagaatactgccaaactgttgaccagtggggcttcttggggcaggaaagcacagactttttagtgtttggcagtccaggacaagattccctggcattttgcttcatgactttggacatcagtaaacctccctgagcttcagttagactttaaagaggtgattaatggtaactggcacaagcaactaacacttaaacactccaagaatgattgggtaaaggggaaatgaaaacagctaagctacttaaaaacagaaaaaaaaaaaagtaagaaaacactacacatcaaagattgttgatataactgaagcagtgttcagcaagtttaactttaattgcaatttctaaagaatagtagagaacatagtttaccatctaatattaggtaagaaaacacacattaaaaggttaagaagtcgggcacagtggctcatgcctgtattcctagtactctggaaggccaaggccagaggatcgcttgaggccatgagttcaagaccagcctagtcaacacagtgtgaccaccatctctataaaaaaattttaaaattagctgggcacggtagcatgcaccgtagtcccagctactctggaggctgaggtggaaggatcacttgagtgtaggagttcaaggctgcagtgagctgtggtcacgccactgcactctagtctgggtgacaaaacaaagcccccatctttttaaaaaaaaaaaaaaaaaaaaaaaaaaagctaagggacttggccacaaatgtaattgaacatagaatctagatctaacaaatgtcctgctacccctctgactctatatgttgggtctacttactaacttttatttctaattatttccttgctcacatggggccagtatatgtcacattaagggagaaagagtgatttctcctgacatcatgtatgtttagctggtacccaagacttggttcacccttacatttttcccattattggcactgcatgttttcctttagcttctttttagtgttataacacgatttaaagacaagttctataaggcttgtcattcaacagtttcctacttacatcccggttttactcccaaagacaaccacttttgacttcttcagccaaaaatgttttaatccccatatctccgcactacgtaatttttcagtttagatgttatttcttactgcaacttgagcatccctgtccaaaaatctaaaatcctccaaaaacagaaaatatgagtgtccacataatgccaaaagtggaaaattccacacctgacctcatgtgacaggtcagtcaaaacacaggtgtacaacacataatttattcagcatccccaaaggaaaaaagaccctgtcaacccccttcagctgtaatatacttaggtaccctccctgaggtgtctcattatatactggatatgctaaatctgaaaaaatccatctgaaatgcttgaaatctcaagcatttcagatacgggatactcaacttacagtttcccatcatggaagatgagcttttagctttcaccctgcttaatttcaccccactctactatttcctcctatcacagtatggttatgattttattcatttgctgtgttttcatttatagctgaaccatgtattacactgcttttacttttgcacaactttgtcttccctagattcagtttttactacacttttatattcttctcattgatttatccctaaactcactactctgtaaatttcttcttatgtcttacagcatgtgtgctcatcttattacggaagtctttcctggagccttctgacctagtccagtgaagcctggctgcttcagacctactatgcatgctgctattgttttgagatctcctttgaaccatcatctggacagttcacttagtctctcctgtagagttccttttcctggttcccatgtcttcatccgtggcataactcctctttttgacagagtacgtcctttgttaatttcataagaagggttacaacaaaatttcaaaccggctgttcagtgtaaaaagatctggatggtctaactttttagattctcaagcaatccttttagcctcattccatccttattttagaaccttttaggttttgcactgtaagtcatggtgattctcagctttaccaccactggcttggaattcaacgttagatctgccaaatcaggtaccactcacccacctgctttctagtcttcaaaactagtgcttttcttttcctcttctctgtccctatgagcttccgccttttaaaaatccccatagcatcattttagtggtgtttgggagatatcagagttgaatgtgtatttaatctgtcattttttttttttttgattcagagtttcgctcgttgcccaagctggagtgcagtggcgcaatctcggctcactgcaacctccgcctcccgggttcaagcgattctcctgcctcagcctcccgagtagctgggatcacaggcatgcaccaccaagcccagctaattttgtatttttttttagtagagacagggtttctccatgttggtcaggctggtcttgaactcctgacctcaggtgatccacccgcctcggcctcccaaagtgctgggattacagacatgagccactgcgcctggcctaatctgtcatcttttgtaatacttcctcgtttgttagttgctatgagtaaatttccataaattacctcaatgaaacttagcagctattgataaacctatgcatcattgatcatagaatattaaaacattaaacatactgactacatatttgacaatcagagaaatagttgacgcttatcaggttactgaccctttgtccagccctgaataagtataattacgcagcctactgaataactgaaactaaatagtggaggaagccagaaaggcaacaagaaataaatacatttgtttcattttcttatctcatattccttttcaatccatttatcagcagaaagcagaaatgaggacaaacagtgcagttctgtcttcctaacatctcaggtacttcctcaaaactgacagttggctaggtaatcttggggtccagtaaccatccagaataacttggaaaagcagccaaatgaaacattaggatagaaaataatcattaatttgcattataatctcccttccatatattccaaatttgagttgctcttgtaacagtgacttaaagaacctaaagtttacatttctgatcatggcccattttttttgaccagtctcacactgactaagaaattttgtgttaagccagtgttgtctactgtatttttcacttttaaaatagcattaatgaggccaggtgcagcggctcatgtctgtaaaatcccagcattttgggagaccaaggcaagcagatcacttgcggtcaggagttcgagaccagcccggtcaacacggtggaaccctgtctctatcaaaaatacaaaaattagctgggcatggtggtgcacacctgtaatctcagctacctgggagactgacgcaggagaatcgcttgaacccgggagacggaggtcgcagggagctgagactgcgccactgcactccagcctgggagacagggcaagactccatatcaaaaaaaaaaaaaaaaaaaaaaaaaaagcgttaatatgttaatgaccaatatgctgggataaaaactaaatgttgtataatgaaacaatttcaactgactaaattagactttcaaggaattaagatgaaatccttaaattttaaaagaaagcaaaggcaagtagaaatgctaagacaagacattttatggtttggctttcttttttttaaagacctacttatgaggcaagcaaattctctcaatttttttcctcccctactctaatactactattcaattcaacacataggggaaaagaattgcagtcttttctggtactgctaatttcagagcctgcaaaacaaggggcagggttttggtgggggtgacacttatgtagccttcgttttcagtgcccatatcaccttctatactatactgcttgtatagagctttggctaaacaggtgaatattacctatattgaatcttgactacacatgtgaacttgcaatcctgtctggctctacccttggatccctaactataggagttttatacaagacagacttagaactcccggaaactataaagagtaagtgtggaggcaggtgatcatgaatctggtctccctcaaggagtagccactatccttgggcttcaaggaagctatctgaaggtcactgcatgctataagccaacatacctgttgatagatgagttccacaagttcttgcaaagcatcatctgttgtaacacaaccattcagggtctctgcaaactgttcaatttcagtttcaaaactgccaggctgctctgtaagatgattcaaaaaatcctgaacatattctgatagagtaggataatcctcacaaccatcctcataggattcctacggatcaaaaatgaaaaaacaattttaatctatgcaactggctaaaacacacaaggtggtatgtctctagcacaaatgcttttttaaagatccctcacatgataaaaatttatgttcatcaataaaattgtcaattgagctatttttcttccttgcctaaaagctgaagtgttataattaacagcagaaaggttctgttcagctaaacagggaattgtcttctcattctgggtcaacttctaagatggctgaggaataaagtttaaaccaatatttcactacaatgccaatataaaaattaagaatctgatccacttacgaatgaaataagatctaggatttgcttcaaagtgggaggggaagtatggactagggatataaaaacaagaacggccacatgtagcttactgttgaggccatgaggattcattataccattctctgtatttctgcaaatgttgacaacttttttattggggaaaaaaaaaacaaaaacaaaaacctaataaggtttatcatctgttaatccccaagggcaaagaaatgcataaagctgctcgagtaactaaaatttcatcacggtataaatggaaggagaccttttggctgctacatccaggttgctaacacaaccttgatagcagcagtagtttccagctaatgttgtttccaccactgtcacctttggcagtttccaaccttttcattaatggcagaaggctgagtgggcgagttttacaaaagataatagacttgagcaacaactttcacatctcaatgcctggaataccacccgaagcgctttaaagtttaccaaacagttaaaatctaataataactacactgcttgtatgaaatttaaccttctccaaacagagtaaatgaaaagccacataaaaaagttatgactacaaaacagaagcattttgtgaaggggttaagttctaaagtcagtgagtgcatagaagaaaaaaaaagtcatacatggtcaaaacacccttagaaatgctccatgttggagaaagacagtctttttttttctttgagacagtcttgttctgtcgcccaggctggagtgcagtggtgcaatcttggctcactgcaacctccgcctcccgggttcaagctattcctgtacctcagcctctcaagtagctgggattacaggcatgcaccaccatgcctggctaatttttgtatttttagtagagacagggtttcaccatgttggccaggctggtctcaaactctgacttcaggtgattcccccaccttggcctcccaaagtgctgggattacaggccactgcgcctggcccaggacacagtcttaggagaaagaccaacattgccaattgtccacttgtccctttactgttggtgcttgatatggtttggctgtgtccccacctaaatctcaacttgaattgtatctcccagaattcccatgtgttgtgggagggacccaggagggaggtaactgaatcaatggggccagtctttccggtgctattcttgtcatagtgaatacgtctcacgagatctgatgggtttatcaggggtttccgcttttgcttcttcctcatttttctcttgctgcggccacgtaagatgtgcctttcacctcccgccatgattctgaggctttcccagccttgtggaactgtaagtccaattaaatctctttttcttcccagtctcgggtatgtctttgtcagcagcatgaaaatggaccactatagtgctaccacttcaaataaccatcatttggaggtcatgttttacactttttattttatctttattttttatttttatttttgagatggagtctcgctctgtcacccaggctggagtacagtggcaagatcttggctcactgcaacctctgcctcccaggttcaagcaattctcctgcctcagcctcccagagtagctgggactacaggcatgtaccaccaggcccagctaattttttttgtatttttagaggagatggggtttcaccatgttgatcaggatggtctcaaactcctgacctcaaatgatccacccaactcggcctcccaaagcgctgggattacaggcgagagccaccatgcccggcctatgtatcttcagagactgaagtgatacttagcaaaagttgcatgtactatgagaggcagtcaggaagtaaaaccagctgcagaaatagcagattcatgtgcctttttcattcacatatagtgttcattgaatagaaggataaactctaatacattagatttttgtcacgcatttgaattcaagttaaacattctactataataggaggtattaatgttgatgcatttatttactaatcataaatattatcactgtgactctgaggattaagtgaattaatcaaattcacctagattggtgaagagcacatagtaaagcacagaatgttcaacaaatgaattacattttaaatttctaggagaatactgagtcatattccaaatgcaacagccatgtattcatacataaagggactaaagtataaaaagcatccaaaatgaatgataaaaagctgtatttcttggcacctaggatggtactccagttaataagctaatagccaccagctgcatatatgatatgtgatagacaccataagggctttgcctgcatcttgtttaacctagaacattttgaggtaagcatcactatcctccctgcatagaagaaacaggcacagagtagttaagtcactttggttattcattcaaaatggtgtggctgctgagtacctactaagtgccaaagactgtcttaggggatgggatactgccatgacatgaatatctgccatgaataaagcagacaaggctctcctctcatggagctcataccccatgatggaagacacattcagaagttgaaatatactacaaaaaaaaaaaaaaaaaaaaaagcaaaaagccaagtagagattcttagagttaatatataaactaagaaagaaaaaaagatccagccatacaaatatctaaggaaagatattctctttctatgggcacaagaagcacacaggccccaaggaggcctaataactttgaaaaagacaataactagaatacagaaactgaggatgggtggtaactaatgaggtcaatgaggcagataaggagatcttagagggctttgggggccaaattaaggaaactggctcttaaggaagtaggaaaaacaggatgggggaaagagggtttgaacaaggaaggaccatgcaccaacttaagtgactgtgcatggtcacaaaactgattagaagaactgagcgcagaacaaagcctatatttttaacctctctgtgaaactcaaaataaaggacaaaagcttaaaacccaattttatgtacaaagatgttcattgccaaaaaatccacgtaacaatccattaacaaggaattggttaaatacattatcatatatctgtataatggaatattatagccatttaagaaaacaagagacaacagtacttacctctagagtgagaaaatgttcccattataaatattgacattataaagttgtgaaagcagttaggcataattgtacacattcatatacttaatgttaactacatacatgcgtgaattttataactaaaaactagtcttaagtttttgatatacagttactagttttacagacttgtagtatcctaccactattaatgacaaggaacagcagaaaggcaaaggtacgggtcccagctgaaagtactaatttcctgtttccatcaaatgtcattcttcgtggcaaaaatgctgcttagagcgctgatttgcaatctttttttttttttttttaaagtcaacagaactctcttttaagaaaatgtaaaatctgatcagtaaaagaagaaagtagaactgctctgaatatagcagaacagaggatccagagcctgccattttaagcaaaaaaaggaggcatagagtatttggaacagacaggcactccaacgtgtttgaatcaaagcctgcattacttctctagcaccagattttttaaagccacaaatttcttcagtcttcaatgtggagtcaaatggcttccaaacagagatattttcaagttttatttttcttagaattctatgggagattgggagaaatagaaaatgtactttttcatggtaggtactctatatacattgtcaagagatgagaacctattacagaaccgtgggaataaaagaaaactgatcagacactacagagagtgaatatagtcacgactactttagctagctggattgaattaaggcaagggtgtgcaggagaggtgagtcaatatgccaccaagttcttagtgtaagcagctagttagaagagattcgcatgagataaataattcttacactgtgtatagattttatacttgcatttgaatgtgaggtcctcaagaagtggtcaaataaatgaaaatgtatgcctagagttcactagagttcaaaggaataattagatgtcagggttattagcacataaataagtgatagattctatggaataggcgggattagcaaaggaggtaataaaatggaagaaagaacgtcaccaactgtcatctgaggggaaaaggaatgatctgcaagttgggaggataaagtactgccacagaagccaaagaggtaggggagaagagatgctcataacaacaaatgctacagaataaattcataggttgaaatctggaagagaattatcattgcagagtctcgggagtgaaggagattatactcagagagaaaaaagaacaaaactagtacctcaaatacttagttcttaaaacaatgggagggagcttctgatagactaaaaaggtacctttgcacctagcacaggacctggcacatggggatttataaactgaatagatcctacagtgctcaaagttttaaaatgagatttaggaagataaatttaaaaatcggaagaacatcagtcacaaaaatagtatcaatacaattagggagatcagactgcagaggtctgaacagtgagagacagtgaataattttacctattggagaatgatactactgcaaggcagaacaaaaactgggaagtaacttgaagagggattctcttagaaaaaaagctcgtttttttgcaggggaggaaggggacttctgtctcttcatcaatgctttatgaattcctatgttaaatttttggctctggtaagtgaactgtgacaaatattcaaggcataatggtttgtctgagaagaaataatggccagggataaatggatatagcaactcactggtaagaagacatggaaagtaggaaattctagcagcaggattagaggaagaactgaagataaaagggcttggtgccttgaaagagttaagaaagcacagcagaagactaccataaaggctgttagaaaaaggataccaggaaatagattttcatgtgtagaacaaaagcagattcaataaatgtctgcaaactgagccaggagactactagaatagagactccatgaagacaggaatttctgtccattttgtttgttgctgtatcaccggtgcttgactcatgataagtacttgactatttgttgaatgagtgaatgtagctaactttggattatggctactaaaaggaaatgtttcctttgcaacaagagcttatcctaagagtcgggggaaaaaaggatcctgctgttctatgactaattggattgagaaaaactctcttagccttaactatgggtaaagattagggtaaaccagtaaggctagagaatataccagaacaggggtagtaagcctgaatgcctgtagaattcaggtagattacaaatgaatgaaataagccagaaagcaaattagagctcacagactccatctaaagagaatgcctctactcagctccaaccaatttttgctgtatcaaaatgccagtccactaaggccagattttatgacaaaccagaacattcaagtttctaatatctaatttaggtattggttaattaaataaaacaacttaaagaaaaaacaaacccattcagggctagagaagacacctgcaggccacacaggtttccaggtgccaggctgcaatctgttttggtaaattgagcacaggaggtgctgatctattagaggatggcaaggaatgcctaaaagatgcagtggctcaaagtaggtggactaacatgactttatatactgctcgacagccccaaagtcacttgaaccacgtaaaaatagttgatacacgattattacatacacaaacacacccctgtatccctccatcataaaacagcccaagtcaatagggaagaaaataaatgggaacctgcttgtagctgctagaacaagcatccttaagagtttattcaacctcttacagtggctctaatggttcttttcctctgtgagctaaatacaattttctggcaagaactcaagatgctctcatttctaccttacacgatagatggcctttttcaccccatatcaattgcttttcctgctatgcctgtatctttttctttccaatcccaaagctttttcctatacagcataagaatcatggagtatctaaaacatggaacacagctttttccatacttttactgtcaaatatggaaggagagccaaaaagaggtaataaaaaaggtgtgtcattatcagttataagggaaatataaattaaaaccacaactagatactatatgcccaccagaatggttaaacagaaaataccaagtgccgaccaggaagcagagtaactggaaatcatacactactcagaatgtacagtggaacaatctctggaaaactacttggcagtctctgctaaagctggctaccctaagtcccagcaactccataccttggtaatataccaaaaagaaataaaggcatacagccagcaagacacaaaatgtgccctattcataataacccaagagtgaaagctaccaacgttcatcaacagacaaatgggatatattcatgcaatggaatgttataaaaataagtcacctccaattatatgctacaatatggagtaatcttgatattgaaagtgagaaagaatatattctatatgactttatttatataaactttgaacacaggcaaaactatcctatgaagtcaaaacagtgctatacttggacatcaagaacaactggaaggagacagagtgggttttcgggatgttgataatgttctatttcctgactgggatgctggttagttgagtgttcactttatgagactgagctaacacttaagtacactattctctgctatacttcaataaaactaagaagataggaaagacaggatttaagctaaagtatcatcaatcatttctccaatgattccctcccacttctctataattaatccctatgcatttactcatctgggtttatccagtacaacaaattcctttctacatattccaactgtgctttgtacggctatttaagaaaagtgactattttttaaagttgttatataagtgacaaagaaaaactgaaagtttaaacattctttatacctatgtaaatactttatcacaaccccgtaggacatttctgcatacaataattaggatcaaaactatgtctattttaacataatggaataatcactagaaacaagaacacagatgtgtatctcaagcttacattctaataccttgaatataactacaaaatgtatttctgaatcagctttgtttccttctgagttcaataattcaaaacattcacaataaaaaaatttttttacgtgtagtacagaaagcacaaacatactctgattaacaaagtaacaaccacattattccagtaaattaacccagagttgtaggaaaaagggtgtacttactgtgtaactggaagaataacctgaagggtaaaattcaggggcattcacagacagcttagacattaatacaggagctacaaccacctggggcttagccattgctgactccgagttctgctgtgggattttatcctgtgaactaggtggagctctcaggggcctcgtttgctctgcaaaagaaaaaaaaacggggcgtcagatgcattctttcctttgtacagcaacttgctatatactgaaaaaccatctgaaaagcgtctgtttttaagagttaaacaggaaccatcatgaaatttatggttatcgccggaatgtgtacagacagcctacaaaaaggaacaatagacttgctgtgactccgttatgggcatacctgcctctcaaatgagtgcttgcgagcttttttcctctctgtcgttttaaaggggtcggtggaaaagaggtggttactcgctagggtctcgctttagagggctgctgaggggaggcgatttttacttcctcccgggaccccgaactccgagaccgcgcacccggcccctccccccagccaggcgcacaaaggattccagcagacaccttccaaacccggttccgggcccgtccctacccggtcacgcggccctctcggggaatgctttcggggaaccgggggtggggaccgcagacagcgcgtcgggcctcggcacgcgtggagggccgtggggaagcgttcgccaaggaggactggggcccttagagctgctccgtacctgggagcgccccgggccgggaaggccgctgggggctggcggggacctcgcactgggcccctggcggcggggtcgtcctgggctggcgcagcggcggtggctgcaggaagcccggggctttgggttgcggcggctggtgccgcgcccgctcagcaggccccgctccgttcgggaaaccgccgccctcaggcccgccccctccgcggcccaggccccggctccggccccgaccagcacctggggcccgatcgaaaccgtccgacatgctcctcctcctccgcctcctcctccaggggccgctgccgctgcgctcgcgataggacgcggggggaaggcgccgcgggtcggctatagccgccgcgcctcactcgggcctcatggaggaggagggcggcgggccccggctcggctgctcggtgcttctggcggagcggacggcagcccgagcacccgccgctccagagcgcccgccccgctcggctaccctcggctttccagttctcccccaaaacccggctccccgccttcggcgcggcaggggcgcaggcgggtcacagcggccccctgcggcccggaggcccgggacgcgcccgcgaggatcctccagttcgcggctggccggccgccgggcccagcaggccgcccgccgagtggcgtcttggccacctgccggcccgcagccaggctcgggcaggggcatctcggttccggggccaggctgggggggatgagggatgaggggtgagggggacgcttaccacaggcaggcccgacctactcggtagttctcaggagagacgtgcgagaccgacagttgacgcccgggaaataaaaacacggggggagggggcgtggaccctgcgccagggttcgctggcgcacaggtgtgttcaatgactcggctccggccgagacccgcggactgctgaggagtggtccctgggagactgtcacctgctccgttagcatcgggggaagggagtagaaacggaatcaaaatatgtgtcccctctttaattcaccctaggtgtttaccacagtaggtcacacctacgtttaacaagcttcgttctcttcccgttaaccttcccctccagaaatttcaagaaaatgtgctacctttcagtgtaactctgccctctttttcatcttgcatcagtgctgtccaatgaaaatataatgcgagccacaaatgcaagccacttatgtaattttacattttggagaagccacattaaatgagtgaaaagaaacaggtgtggccaggcgcagtggctcacgcctgtaatcccagcactttgggaggccgaggggggcggatcacctgaggtcgggagttcgagaccagccagaccaacatggagaaaccccgtctctactaaaaatacaaagttagccgggcgtggtggcacatgcctgtaatcctagctattctggaggctgaggcaggagaatcgcttgaacgcaggaggcagaggttgcagtgagccgagatcgtaccgttgcactccagcctgggcaacaagagccaaactctgtctcaaaaaacaaaacaaaacaaaacaaaaaccaggtgaaattaatttaaatttatttaatccattatgttcaaaatggttttttaacatgcgatttaaaatattaaatattttctctgttttttagatactagttgaaatccagtgtatattttacacttatggcacatcttagtcgggattggcacatttcaagggctcaagagccacatgtggctagtggctactgcgttgcacagcacaattctagattttattaatatgtaaattgttgtttttgtcaggcctgacagtattaatgccaaataaaggatagatgaatataagtaacgacaaggaaggaaaaattgatttctttactgttggattgatccatctccataaattctgattttagccttttgttttaagcagggtttcatgtttttctatcttttcatcttaagaatcatttcaattagggacacaaactcttgttaaccgttttctcttctcattaataaagaaaacaatgtcttcccctaaacgaatgagaaaatggcttcaccgagggcaatcatgaataaatggttcatgctattgatgttaggcaaaataatgaagtcagggaaggaagccagcagtacgtgtggctcttcggtgtacggaaagtttaggattcagtctgccagagcttagttgggattccactcttgactattgctgtctgtgtgattttgagtaagtaaggggtttagcttctctgagcctcactttcctcatctgtaaaataataactgtgtggtaacactcagcatatattgcagagacaagattacaatttaaaaattacaattttaatattttcaaattcattattgtatgtggtcaccagtcacttcttgcctggacttttttatcatacaggaaagacccataaactatgctaaaaaactaacaatgagttatgttccactgaagtagatgccccaactctgccccaagcttttgtttgcactcaccaccttttcatttccccttaaaacttttatgatgaacagcaccttttctaacaactgggactttcccatgtgaagataaggccattctgcatccatggtgatgtcacgacatcttcacaccctcttgttaggaaaattaggtaagatatcctttgccttctctgtatttgttactgtataacttttgccctattcttataatgtgtggatggtggacttggagataacacgaatggattttgcatcatgataataaaaatatctaatatttattatgcgtcagtcaccttttaagagcttttattttatcattttattttatcctcatatcctgtgagatagacattccaatattttcactttacataaaaggtgccaagataccgcaagggctcagatccatcttgggactgttttagagctaactggcaggtattgcaaaatgcatagacagaaacacatgaacgtgtgaacaccatgtggaactccctaaagagaatcatcaaagtgctcctcatccacgtgtatgccttttttattaatttatggtgaaaggagagtagaactaaatttggacaaattggaaaatatgttgtaatatggaaaaggacctgctgtgaactatgaaaaaaatgtttccttaaactgtacttgaaaggcattctccagtaagacttcccaagctgcctaatcttagattctctcccttgtgataagtataccctgggaaaactgtcttggtacttagcatgccagattgttatcgttagtatttggtttatttaaatgtctccttccctaaactagccctctgaagacagaggatgccttttaatcctttaggtccaacccagtacttagtccataataagcttttaacagaaataggactcacctgcaatggtcctgcctttccttaggtcaccagtctagtgatggtaaaaaaaaaaaaaaaaaaaaaaagactgtttttttagaacttattgacctcaggatcatcattagaccttatgggagtagacagtacagccttcaaggccagctaacaggagaaaattttcataaatatgcaagaggaaatatttgcaaaccacatggtatagtttgtatatttgaccctccaagcctcctgttgaaacttgatcctgaatgttggaggtggggcctaatggaaggcgtttgggtcatggtggcagattcctcatgaatggcatggtgccattctcacagtaacgaatgagttatggttttactagttcccaaggagtttccccaagagctggttgttgaaaagagcctggcacactccccctgtctcatgcttcctctcttgccatgtaatctctgcacactgtctccccttcactttctgccatgcatagaagcaggctgaagccctcaccagaagcagatgttggtgccatgcttctagtacagcctgcagaatagtgagccaaatgaaacccttttctttataaattacccagcctcagctattcctttatagcaacaaaaatggatgaaggcaccacatatttgacaaaagacttgtatctagaatatataaagtactctcagaactcaactgtattgagagtactatagccaggtgcgatcccagcactatgggaggctgaggcggacagattacctgaggtcaggagttcgagaccaacctggacaacatgtgaaaccccgtctctactaaaaatacaaaaattagcaggcatggtgatgcgtgcttgtaatcccagctacttgggaggctgaggcaggggaatcgcttgaacccgggaggcagaggttgcagtgagccgagattgcaccactgcactccagcctgggttgagcgtgactccgtctgaaaaaaacccaaacaaacaaaacacctaactcaactgtaaaaggacagttcagttagaaaagggccaaacataaatgaaagaacacttcactgaagggaatatacagatagcataagcctatgaaaaatgttcaacataattagccagtaggaaaatttttttaaaaccactgagatttcactacctacttattcgaatagcttaaataaacaatagtgacaatgcaaattcaaggatgtagagaaactaggaactgtgttgctcatacattgctggtgagaatgtaaaatgctatagtcactttagaaaacagtttctttaaaaaactctacatattaagtactgtactacctagcaattgcactgctggacatttctcacagagaattaagatttatattcacataaaatcctgtacccaaatatttagagtggcatcattaataagagccccaaattagaaagaacccaaatatcctttgatgaatagttaaactgtggtacattcataccacagaatgctactcagcaaaaaaaaggaacaactgctcatataagaatgttgatggatctcaagggaattatgctgaacacaaaatttcaatctcaagagcaattgtatgattcaatttatgacaaaattatgaagatggagagcagatttgtggttgccaggggttaaggagggagtggaatttagaggcaagtagatggggttattaaaaaagtaggtagcatgagaaaaaccttgtgatggaactattttgttctttactataatgatggtcacataagtctatacatgtgataacattgcatagaaataagtgtgcacacatacacacacatacacacatgtgcatataaaactaaggttggtgaactgtatcacttatagttatacaagatgttactattgggggaaacaaggtgaagagtaaacaagttctctctgtattatttcttacaattgcatgtgaatctacaactaagttttagaaacctaacatataaataaacttcgttccatgttattccatcactcctaattctctcctagctagttcagttcactcctttctgcacaaatcatcatggcaacttacatatcattataaatgagtgggggcatcattaagagagaaaaaaattagctgatgcatttgtccttgtgtttctcatctgtgtaaattatcttcctctggccactattaaaagtaaccccaggcagtcagctcttgagactcccatctggattagggccccaattcatcttagagtctaagatagccaggaatgctgcttggaatctcctcaatatctactgatacttgtttaacgttgatctcttagctgtactgtaaattccacgaggctaatgaaagaaaccaaaatatttcaccttgacatagttcaagatggttatttggatgggctgaaaatataagagtagctaaaaacctgccttttttggggaagattggatctgtagagacaacttgcattgatgcagtgaggctttctctgagaccctcacttgtcccatctaggaaagattaactgagactctgatacctttaaaggtttataaacattctctctgaggactgctacctgtgagatttcatctacataataagaccacctttgctagccagttctcctcttctctctctctctcccctaccgtgtcttgctactataaccgatttaacaccataatctgtttttggctatgtgctgggattcctctctttctgtaacttcaagatagtaagtatatcagcttctgtaccccatttgggtaattactttctgagtctcctctgagcatagtcatttcttttttttttttttttgagacggagtctcgctgtgtcacccaggctagagtgcaatggcatgatttcggttcactgcgacctccgcctccctgggttcagtgattctcctgcctcagcctcccaagtggctgggattacaggcacacgtcaccacgcccggctaatttttgtatttttagtataaacggggtttcaccatattggccaggctggtctcgaactcctgaccttgtgatccacctgcctcggcctcccaaagtgctgggattacaggcgtgagccaccgtgcccggcctcacagtcatttcttttaatatatcttttgtcagttgatttttcagtaaaactttagagagcaaaggggaagttattctttggcccccgcaataggaattcattcattcacttgttaattcaacaaatactgattttgtgtctacttcatgccagcagtgttccaggtgctgaggatatgcaggggtgtgagattagtaggtttgaggcatatgagacatgaagcagggaaacaagttcggtggctattgcagacgttctggtgataaatgatggtgtctagtaaggtggtgctagtgggtttggagggaaaggccacactgaagagatgttgaggaagaagttgacagattgtgtgtgaggcattagtgagaggccagagatcagggtgagttccaggattctggctttggtgcctcagcctgtaagatggaaaataccaaaaggaaacagatttagggatagacgccaaggaaaatttctgctttggcctctgaagtttcactgaaaaatttgctgacaaaaggcagactaattggagaaaagacatacaaatttcttaacatgtacatgggggagaaccatagagtgatcactccaacccctaatggggttcagaagcttatataccatattgaggtgacaggaagaatgggggcttagattgtgacaaaacaggttacaatgacaaaacaggttatgggagacagagataagaggaagcctggctagcaaaggtggtctcgttatatagatgaaacctaataggtagcagacctcagagaggctagatggtgaataatttttcagaactttaaagtcatcagactctcagttaatcttttcttgatatagacattggaaggcctcagaaagaacctggctgcatcaatacagattttctctacagatgcagctctcccccacaaaaggcagctttgcagggatacttctatttgcaggccctctgaacagccatggcaaaatatgtcaaataaatacattttggggtgaaatatttttatttccttcagtcctcattttgaaactttaagaaggtttacatattaaaaagccgagttgatagctttggagaaatttggatcagaggttttattagtctattctcatgctgctgataggcatacccgagactgggtaatttataaagaaaaagaggtttaatagacttacagttccacatggctggggaggcctcacaatcatggaggaaggagaaaggcattcttacatggcagcagacaaaagagaacgagaaccaaggaaaaagggaaaccccttataaaaccatcagatctcgtgagacttatttactaccacgagaatagtgtggaggaaactaacccatgattcaattatctcccaccacctccctcccacaacacgtgggagttctgggagctacaattcaagatgagatttgggtggggacacagccaaaccatatcagagtttcttaggtatgtcagaggcattgaaaccagagagactttgtcttgaatgagggctgggaaaaagccatcgttcaatgcaggcctaggctgcattcccaggaggttaggcattcctagcctctagatgtttatggttaaggaaacagattaataatgtttactaaacagacccaggcccagcaatgtcctgatatccccatatcttgagaacaaaagcattcctgattttgctttaaagataatatcaattcttgtaaaatataataattaagaaaattaatcctttatcacaaaccctgtagtagagcatatatccctgtgattttgtttttgttatcctatacataaacaagtattgtacttagggtgggtgcattcctcctcctccttttgggaatgccctgctctgtctatggagtagctattctttcactcctttttaaataaacttactttcactttgcactgtggacgcaccctaaattatttcttgtgcaagatccaagaaccctctcttggggtctggatcgggacccctttccagtaacgtctttctggtgaaccacaaagggattatactgaagagacccctgacccaaaggaaaatcatctgtgcactccaccaggtggccgactttgggtaagtggagtgcatttacctaggtagaggatgggattaggttagaggcccaatttaactctctcctaagacagggaaggttaaaggcccctcttaataaaagtcaaagacacttgaccgaacttgggttcaggcccaacttaggaaggttggagtccctcccaaggtttagggggttgaggccccattcagtaaaatccctcttggctaaaaatgggtttggcaccgtgggatgttaactgctatgttctttgtattaatctgccttgtcctctttgctgcacgaatcaatttcttggttgctgtctcggtttcactgtcattttcaggaaacttcatttaattggtcttagggatttgaactttctcttcccctgtgtacctcctgatttctgtccacttgcttttgaaacattgggaacaaaatgcattgcaggatttggttttattatatttggcttattttaaaactctagctgctaaggtcccatctctaaaactgctgattgagatttggtatttaacaggtatgagcagtaagattagatagatgtggttatgttttgctgcagctatgcccactaggtgtaataaagaagcactaggatggtgatatggtttggctgtgtccccacccagatctcatcttgaattgtagttctcatatttcccacatgtcatgggagggaatgggtgggaggtaatttaatcatgggggcagttacattcatgctgttcttatgatagtgagttctcaccagatctgatggttttataaggggctttccccacttttggtcgggacttctccttgctgccaccatgtgaagaaggatgtgtttgcttccccttctgccatgattgtaagtttcctgaggcctcctcagccctgatgaactgtgaatcaattaagcctctttcctttataaattacccagtcaccgggatgtctttattagcagcatgagaacagactaaaacagatagaaatcaggggacttttctccctgcttttttgtttcatttgcacactaaaagaattctttcctttcttggattcaggtaaattggctttgcttgtccaatccatgctaccattgttgcccagaacatgcttgctctggtcatccccaactaaatcctcttcattttgtttgccttatttgacatttattttgtcaggtttcatattgtggtttatttaagatgcatggcttagctcatttatgttatttggcttgtgtgaataagagaattcagttttcagcagggatctcctcattaatgcaactggccttaaaacctctcctatccttttcagtggaacttggccagtggcaaaacagtcttgtaggtttggaacttttcttccaacatcacctgcctccttcatgggaaccatgttgttgattccaaaggactcaatgttagaatgtattcttgaatgttgggaccagtttaaattaaatgggcttaagaagaggaaattggtgtttctatgtaatactgtttggccttgatgttatttggaaaaacaagaaaaatggccacctactggaactacagccttgaatactatacttcaactcgatttgttttgtaagagggagggaaaatgggatgaaatgccacatgttcaagcttttttgttgttcagtcaggagaaaaccctgcagcaggcatgtgcatgtttgatgagaggaaaggaagaaaaaaactagccacaatagatgatcccttgatgcaagccccccaagttcagtgggcatttttgggtggagcagaacctcctctgtcagctctgagtattcagtgcattggcctcttctccctttagtccacctggaagttgtactgaagccccttcatccccttctccttacttgtctagtcctactttatacccaccacctcttgaagaatctagccttgcaggtactacttgtagtcaagcctctttttaatctccaaagggaaatctttgtccacttagacaagtggagaacagagaagaaggcactgtaagagtacatgtccccttttctatgtctgatgtggctctatgtaaagagaagtttggccatttttctgaaaaattgaggaaaatccatagatgagtctgagtctttatgtaactcttaagtatgctagacttttaatccagctgcctatctgcctgaacccacaggcaccctatatcattatttttttattttttatttttgagatgaagtcttgctcttgtcccccaggctggagtgcaatggcatgatctcggctcactgcaacctccgccttcctggttcaagcgattctcctgcctcagcctcctgagtagctgggattacaggcacctaccaccacgcccggctaatttttgtatttttagtagagatggggtttcaccatgttggccaggctggtctcgaactcctgaccttaggtgatccactcaccttggcctcccacaatgctgggattacaggtgtgagccaccacaccctgacaatcattcttgtatacaagttacggagcaaatttattccagctggtcaaattgaacggctaagcctctagataatcctgaagtagaatggcttatagatggaagtaggtttgtgcaccagggaaacagaaaagctgggtatgccgttgtcagtcaacatgaggtaattgaatagaagccttaccagcttctactttggctcaaaaagcagaattagtagctcttattagagccctgcaattggaaaaagacttaagaatcaacatttacacttcctggtacttcatgctcatgctgctatctgggaggaactgctaagggctcccctgtgcaacatcatttggaaaatttaaatctattagatgttgttttgctgcccaagaagtgggtgtaatctgtttcagaatgcatcaaaaacgagactgtagtgtgacaaagggaaactcctctgcagatgctgcagctaaggccgctgcattaatggagccagctggacttgtaggcatattagtgcccaccaccccagtaatgagagaaccgagatgtactgagagaaataagaatgggctaaaggtcagggtttaattcaagatccttctggatgggtaatcagtgaaaacaactgttgatactgggtgctaatcagtgggaaatagttaagtatttgcatgattctactcatttgggaagagattcccaatttcagttaatgtctcgtctttttttttagtaaaaggcttatttaaaacagtaaagcaggtaactcgggcctgtaaactctgtgcccagaataatctgaataaccaatctttacctccttcttcagtaaggtctgttcagcttaggggaacataccccagtgaagattggcaagtagactatactcagattaccccaggtaaagggtttaatatttagttattcatcgacacctttaccagtaggattgaggctttccctacccggtctgaaaagacaattgaggtttctaaactgctatgaaggaaacaattcctagatttggcttgcctaagagattgcagagtgataatggcccatctttcatagtgacaatactccaaaacatatcttcaggcctaggaattcagtactgccttcatttagtgtggaggccacagttttcagggaaagtagagccaatcaaacactaaaaaggactcttgctaaactctaacaggaaacatcagcaacctggctgtctttattgcctgtagccttgttacagattccagtggcccctcatgagaaatctgcagctcagtccttttgaaataatgtatggaaggcctttcttaactacagacttcctgatagacatatatactttcacgctacaaagttatgtaatcaactcaggacaagtgcaaaagacaccccttggatatggaaaccaaagactccttcccctactaaggaagagaatcctattataacccagctgggagattgtgtcccattaaaagcttgggaggaaggatccccagcagatcaactttccccaaatggaagggaccctagcaagttcttcttagtatcccaactgcagttaaacttctaggaataaacaactgggtccacttatccgaattaaacttgtctcttataacatcccacaggccaacggaacacaagagactaataccacttattcctgtgaatcaaccagtgacctctggctcctgttcaaaataaacaaaagggattggtaacacaaagatatggattggcatcctacttttgggtataagatggaatcacacagagagtaacttatttgctgagtgggcacagactttaatttctctacataatcggacaaactgttgggtatgtggagaattgccactttcctctacttctggtttgcccttgaatattcaactggccaacctaagtttatggggactttattatgattgggaaactgaatattgtaaacatattctctcttttccccggtaccatagccacacaggccttagtcctttcctctcctatggagagaaaaaaaggcactttttaatgtaattaggaaacagctaaactccaccccaactttaggttatactgtacctgatggacttaggcagatgacagctgttcaagtactggtatcaggcaaaggacctctttgttttgagaggtataataatagtcaccaccacactggaacacatgatataggatggttgccgcctcaacaacataatcagacccttctttatcagaccacatttggttgggatggcaacataattcaccaaaaacgggtgcctacccttccccttggggatggttatgggcttgcggaacccacggctggccatacttaccttataattgaactggacagtgtatgtggggtcatccttatctcccaggacacatcctcaccaaattggactctctctcatctaactgggaaattgtaaaggctcggcatacgtgacaaaaatgggcatttttgtggttctacctgttggctatattttccccacaggtgccacgatggatattgagctgcgagttgaagccctagccaagcacacggctgcaactttcaataatacttaccatgccttaccttcctaacttaggaaacttctcagattaggcaggtgaccttacaaaattgtatggctgtggaattttaacagcagcctaaggggaaacttgtgctttgataaaaaccgaatgttgtgtgtgtattctggatggtttacataatattacccagcctatgaaagctttagacactcatatctctgtcattgatgcgctgtcagtcgaccctgtatcaacttggttccaaaaactgcctagttcttggcaagccttcctgtttagtttacttgggatgatttcatttattttgccttgctgttgtgaatacattgctgttgtactttttgtgtaggaatgcaagataagcttactcaacgcttttttaaattgaacacttgttaatcttccagatatcccttttgctgggactcagagttacaaatgaccctcaccatactgacgctttctgactgagcttctctctaccctgaatataagagaccctaacaggtaggtaggaatatcattgcccctgttcagcatgaagttacagaagagggatcttcattcttctgcaacccttaggattacggttcctcttgtaaaagggatggggaaaatatgtcagaagcattcgaaccagagtgactccatcttgaatgtgactccatctagaagaataaggctgggacttgctgggctggattcccaggaggttaggtattcctagcctgtagatgtttctggttaagggtacagattaaaaatgtttactaaacagacccaggcccaggaatgaccgatatcctgacatcctgagaacaaagacattcctaattttgctttaaacagaataatatcaattcttgcaaaatatagtaattgagaaaattagtcctttatcacaagcccttgtagtagagcacatctccctgtgattttttgttgttgttgttgttgttgttatcctacatataaacaagcactgtacttagggtgggtgcattcctcctcttacttttgggaatgccctactctgtctatggactatttcactccttcactttcttaataaacttactttcactttgcactgtggactcgtctcgaattttttcttgcgcaagatccaagaaccctctcttggggtctggatcaggacgcctttttggttacagaaacagatagacaaaggagtggaaaaacaaaagggataagcagaaaggagcaaatttgaatatatcattttatatctttttttatcagtctcttagtcccgagaatagatcagttcagttaaacagctatgtctcattccagggggtggcattacagatggactaggactctatatatgaagcggcaaacagatttttaataaaaggtgtttctatgaaaacagaagaaaaacaaaggttaatatctactgtagactatacactagttttttgagagtctctgtagttcttcagattgtagtgttaatctgacagagtctcctggttgtagtttaaatcaggtgttgcagtgaactttctgagtattccatacatcaacaaagcataaaagctgtttatatataagttgctgtagtgatttttcccatagtttattcaagttgtcttgctccagtctgcagggcttcaagaaaagcatagttttaacttctacttattccaagtcagaaacataggagaaaaaaatttaaatgttagcttggagacttgtagccaggaaagaattcaagatttagttcaaatgtaggcaaataattacaacttaaaaacaatggacaaagctagaatctaacaacaggtatgctatcattttcttctgaaacataattcttctctctccagtcccccttttctattaaaggcaaatcataacaggaccaatttatttgcaaaataagttttagttttattatatttggcctgattatttgcataaagtacagcaaaaatagtgattgaccacatataggctcttttaaagtttggctttgttggaactttttcataaggaatttcacattcaacttttaaaaactctcaaggctaagaagccaagacaaggattcacaatcagactgcacttgtaattcctgtataaattggatacactcctctcttgtcaaggttcccaaaatatcctgaggctcctgggcctgccagagagtgacattctttactaccgcaaggtcaggaaccttgtaaggaaactgtgtagacaaggtatcaggctaatttttccaacaggctttttataggctctataaagtcaacttcaaatcctcaaagcagtctggtcattaaaaaattatgccattccaatgaaagccttggcaaaataatcagtgtatccaactgtgttctgttacaaaagaaaacagattcctatcgaatttgtacaaataactatattgccaaaagtgaagaatactcacaaatactttccaaattctggagacatcaggtagagagaaaggttagtgtttcaattgttctcacaaaagtgtaatttatctaattactgtaagctatgtacagctcaaaagaaaaaaacaattttcttgactctggaaaacaaaacataaaaagtatcagcaatgtctcaaaccaaaaaaaggttatgaaaatattattttggcattttatcagttcagccccatgtaattaacttattctgcttgatgttggattagcaatcttcattaatttattagattttaaaaaattattttagaagtttttaactagtccaacggtgtgaattccaaagttatcagaaaactgtgtttaagtgtgtgtgctgtcagggccctttccatggattttttttttttttttttgaacaagcagattttaggctgtagccaattacaaaccacttttgaaaagaatccaagtaaaacaataatcatctgtgaatgacaaaagacttagaagagccatgattactgatgcaattgacaaagaaatttcattatttctgtggtatacaataatttaacaggataacaattattaccaataacatataacaagatctatcaacattttagcaatatgatacaattttgggatgcatattaataacagatttatacaaatacaactcaaagaaaattaaacaacattttttatttgatcagcttcctgtatgattttaatataccaaattagcctaatatgtttcttttggacttccaggggccctatttggacttccaagggctttaatgcccaaaagttagcttgaggtcgaaaacatttaagttagaattttacatttgattttgggaagtttgtcaaatatcaaaggtttaaaacacttgatcaaaataagattacaggtcactgtaagataatagttattcatttagccaaactgataattcaaaaatttcaaaaagcaaaaattttactctttgacagaggggagattcagttttccaaacaatcaaaagacataataaaaacagcattagggaaattctctcctcttattactaatattttttgcagtttactcaaaaggtaaacaaaaatcttttactatttcttattaatgtatacaaaaatcttgttcaaaagagaaatccaaattctaactttgtgccagtgtattataaatgctaaagctaattttaataaagccttataaacagatcaatccaattgcaattgttttcttttcctttttttgtttttttttgagacagggtctcactttgtcacccaggctggagtgtagtggtgcaatcttggcttactgcaacctttgactcccgggctcaagcaattttcccatctcagtcccccaagtagctgggactacaagtgtgtaccatcatgcccagctaattccttttgtactttggtagtgagagagtttcactatgttgcccaggatggtctcaaactcctgagctcaagtgatctgcccatctcagcctcccaaagtgctgggattacaagtgtgagctactgcatccagcctgcaattggttttgactgcacaagaaaaaacataaaaaggttccatgaaccttttataacctcttataattgttacggttttatttctttcctcaattttctatgtccattcagttttaggtccttaaaaaaatagcagagatagtgtaaacctgtctaacaaatagacccagaaaaatatctaaattaaattcagaaaatgtttctattttattttaccccaaattttaaactatcttcatttaccacagattactaatgccctgtgaacttgaaaagcgtttgggcttatttacttaatttatgagtactaatttatttatgtcaagttggtaccatacaggcaatctataaacatagacacgtatccataaaatataaacacaaataaatactttatatcattttttctttttttgagacagagtttcactcttattgcccaggctggagtgcaatggtgcaatctcgcctcactgcaacttccgtcgcccgggttcaagccattctcttgcctcagcctcccgagtagctgggattacaggtgtgtgccaccatgcctgactaatttttgtatttttagtagagatggagtttcatcatgttggccaggctggtcttgaactcctgacctcaggtgatccatccccgccttggtctccaaaagtgataggattacaggcatgagccactgcacctggcctacatctttaaaattttagccacgagaccagtaaaactccttagtttaaaaggacagttgaattcaaatgcagctttgtaaatggaaaggttacagtttgtctgtccttcatggctgaagatcttaccaagttttaagaaaaacaggatagcaaatttacatctcaaaacagagaaaattaagcattttcaagaagaagttagggtatgttagagaaagattaaaaatggacaacaagtgatatagtttgagtatttgtcctcttcaaatctcatgttgaaatgttatccccagtgttggaggttgggtcaagtaggaggtttttgggtcatggtggcaggtccctcatgaatggctgggttctgtccttgtggtaatgagtgagttcttattccattagctcatgtgagagctggttttaaaaagagtctagtgtctttctcacctttctcttgctccctttttggccatgtgatatgcctgctcctcctcttcgccttccaccatgattgtaagcttctttttcttttctttctttctttcttttttttttgagatagagtatcactctgttgcccaggctggagtacagtggtgtgatctcagctcacagcaacctctgcctcccaagttccaagtgatcctcttgcctcagcctcctgagtagcagggattccagacacatgccaccatgcccagctaatttttgtatttttagtagagatggggtttcaccatgttggccagcctggtctcgaactcctgacctcaaatgatccatctgtctccgcctcccgaagtgctggcattacaggcatgagccaccgcacgcggccaattgtaaacttcttgaggttgtcaccagaagcagatgctggcatcatgcttcttgtacagcctgcagaatagtgagccaaataaacttttctttataaatcaccaagcctcaggtattcctttatagcaacacaaaacagacaaacacaccaatgtgacacaaaattatagaaattcacataggatgttacaatgaaagatacaaatgagcagagaggaaattcagaagccttttaaaaataactagctaagcccgggcaacatggtatataactttgtctctacaaaagcaacaaaattagccaggcatggtggcgtgtgcctgtaatagcagctacttgagaggctgaggtaggaggatgaggacattgcttgagcccaggaagttgaggctgcagtgagctgtgattgtgtgactgcattccagcctggacaacagattaagacccagtctgatatggtttggatatttgtccccacccaaatctcatgttgaaatgtaataactggtgggaggtatttggatcatgggggcaggtccctcatgaatggctagggctgtccccttggtgccaagtgagtttttgcaagatctggtcattttaaagtatgtggcacctccccccatactctctttctcttattcctgcttttgctgtgagatgtgcctcctcccccttttcctttcaccatgattgtaagcttcctaaggactctccagaagcaaatgctggcactatgcctcttgtacagcctgcagcactgtgaaccaactaaacctcttataaattacccagtctcaggaatttctttatagtaactcaagaatggcctaatacactgtctcaaaaaacaaaaacaaaaacaaaacgaaacaaaaaatacagaaaaccctaccaaaaacaaaaacaaacacctaaatgtcagaaagtcatattttggagaccaatctagtcatataggtggcttctaatttagtatctgttttctacttagaccactgagttctgggcagagcccattaaggaacagggcaaacaaagcatttgcagtttttagggcctaatatttgtatatgtaaaaagtaggcacagctggaagacagagcatctagatttttaaaaatcaaggattctacttttacactgaaccctgggtcccccacaaaagagggaaacaccaaaggactgggctgcacagtgtttccagagtacacctcactacaaagatgtcaccctgaggctggtgggggtgtgtgaggcattagtgagagtgacagattgtgtgtcaggtattagtgggtgggagacccatatcaatcagcccattctgtgatcagcccatccaccatgggatagttattccttggtggtgagtattcccacagtctccatgtattcaactatgtcttttttatagaatagagcaaagcaacaagtagcctacatacagtaataactattaattgcaaccactgtcagctacctccaaaactgcagccctcaccagtgacccaccagccattgcatacacaaggtcaaattctctaataggtcaaagtaattccttgaacccccaaagccaaagagaccaggtaatgcaatgcaaaggagagtggagctttagacctgataagaacttgcccatgactcttcagactccacaggaagacagaagatcattcccataaagtgggtgagtggtagcttttctatgtttctttttatttatttattattttatttatttatttatttatttatttttattgattattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgattcagagagcacagggttgggggtaaggtcacagatcaacaggataagaatttttcttagtacagaacaaaatgaaaagtctcccatgtctacctctttctacgcagacacagcaaccatccgatttctcaatcttttcctcacctttcccccctttctattccacaaaaccgccattgtcatcatggcccgttctcaatgagctgttgggtacacctcccagacggggtggtggccgggcagaggggctcctcacttcccagtaggggcggctgggcagaggcgcccctcacctcccggacggggcggctggccgggcggggggctgacccccccacctccctcccggacggggcagctggcctggcgggggctgacccccacctccctcccggacggggtggctgctgggcggagacgctcctcacttcccagacggggtgactgccgggcggaggggctcctcacttctcagacgggcggttgccaggcggagggtctcctcacttctcagacggggcggccgggcagagacgctcctcacctcccagacagggtcgcggccgggtagaggcgctcctcacatcccaggcggggcggcggggcagaggctctccccacatctcagacaatgggcggccgggcagagacgctcctcacttcctagatgggatggcgaccgggaagaggcgctcgtcacttcctagatgggatggcggccgggcagagatgctcctcactttccagactgggcagccaggcagaggggctcctcacgtcccaggcgatgggcggccaggcagagacgctcctcacttcccagacggggtggcgg

SEQ ID NO: 42 - DNA, 84036 bp, Artificial Sequence
  Based on Homo sapiens sequence
ctcacaccaactcttatgcccaattggtcctctgccagtgaaggcggggaaggtgaacctgtggccgtcggcagatctgcagatctgccggactgcgggtcggggcgtggcaggggcctagtccccgccccggccgtcagcctgtcgcctctggctcgggccgggcgacgagaccctccctcagcacctgcagtgcagccagagccggtgcggcggccgcgacttccccgacgcggggcgctgagaagcagtgagtgcctgtgtgtacctgccggccgggaatataggacttgtcgcatctcagcccttccctcccggagcgggggcgagaggtcgaggcggggaggcgaaggggcggtgggccgcgagggagaaggagcgatggggtggacgtccttcaaggccggggaacacgcggggctttccaggccgcgggggacggtggcgggtgtcggggcgcggtggcaacgctggagttcccgggtccaccggcgcggtcagccctggtgacccaagccaggggctggggagcaatctgagaccattgcggctgggctgtggggctccccagtcccggcaggtcctggcgccgctgtacatagaaaccgttgccacggcgggaggatgccgtttcttttcggtctccgactgcagggggcggtcggccctgtggatgcaggaaagagggtgcctcggtgggagagacccagcttttcgcgttagtaggcccgagcagtttgaactggaggtattactaagctggctacgaaatatgggaggtggatgtggatcaggatgatggagaaattaaatccagctaggatcgaaggttttcccaattagaaacaaagactgcaaacagaggtggaagagttctaaagtattgtataacttgttttttggaacttgagatggacattcagtagtcttgagaaggtgtatcctacagaaagaaagaaaaaaagagaatccttttttttcaaaaaggattctcagagagacttggtccaaaggtagtgagttctctcacttgattgttcagttatagatccacctcctcgttgtactctttctccccttctcactactgcacttgattagtcaaaaaaaaaaaaaaaagattctcagagaaatgttaaaatgatgttcagaatgaaattcatttgattaggtaagagatggctctatcatttcatgtgtttttaatcacattttattgaaatcataaaatctcaggggttgcaaaataccttcaattcaaggtaatctattttaatcccattagatgcttagatctctcccaccaaagatcccttgctctttggaaaaatccttctaaggcaacccattctattctgggcagcatcaataatttacgagttcttcatcttgctttcctgtaacttctacccttgaggttatccttgtcctgggagccattcatcaataggccctgaaggtatggtgtgaaagccacatctaatttctcagctagatctcatccggaagcctaagaactgtcatctatatcatatacctaagtcaaagccggcaggaatttggagaagtggacagtgtcatccttttctgcagaggtctgatatatgaccagactcccagagggctgaaagaaatacttctatgaattagacccattgctacttcttgtttttaaaatcattgcccaagtacagtgggttttctttaacctttgacagtgacccacaataagaaatatagtttactttgtaacctcgtgcatttatatacacacataatttccatttatatagacatgaagtaaaagtttgtataaagcaatatttactttaatgttatatgtcaggtagtctattttttattctattccatctcattataaaacaatgttaattgcaactcactaaatttatttatgggttgctacctgcagtttgaaaatcactggtacagtggttaagtatgtgggctctgtagttagcctattgagactcgtatccttagttcacatgtcgacttgctcatttgtaaaataggagtaattattaatatcctttatgagagaggttttgaagattaggtgagataagctatggcacatggtaatttagctccataaatgttaactgttattactaatgtcacttaaaacctacccggtacagtaattgagggattaaatgaagtaatatatgtaaagtacttagaatggtgcctagcacacattaagaactatatatttgttgctattattattatcattagcattagcagcagtatctttaaagtgatgttctccaagacctccttattcccaattcaattaaatgcagcgaatgtttctgaaggggtataggcactacttattatgttagtcctggagctgtgaggataaataaagtaagttctttcacaaactagaagggaagacaaataaacataattcaaatttgtgctaagagagaggtatgtacagggcacggcacggtggctcacgcctgtgatcccagcactttgggaggccaaggcaggcagatcacttgaggtccgtagttcaagaccagcctggccaacatggtgaaaccccatctctactaaaaatacaaaaattagttgggcgtggtggcccacacctgtaatcccagctactcaagaggctgaagcaggagaatcgcttgaacccaggaggaggaggtggcagtaagccaagattgtgtcactgcactccagcctgggtgacagagcaagactccaactcaaaaaaaaaaaaaaaaaggagaggtatgtacagagtgcccttagaacacagttcattgtgtagtagggagaagaagtaggcagggagtgggaaaaggattgtgttaaggcaagttacagaaaggatgttattatttatgtttatggtgaatcacaaagaatgattgggatgttaacagctaaactagcagaaggtcattcaaaattaacattaaaaaatcttaaaaagcaatttgggcaccacaaccttctctgtcattgtattccagctttgcttaagtgaagattaagtgaggtaatctgtgtatggcacacagtaatttaactccataaatgtcaattgttgttatcagggacagagaattcaaaattagttgacttcctccatggaaaaaaacctctaccttctttttctacagaagtacctagaagggctgggcgtgatggctcacacctgtaatcccagcactttggaaggccaaagtgggaggatcacttgagtccaggagttcgagaccagcctggggaaaatggcaaaaccccatctctacaaaaaaatctaagagaaattagctgggagtggtggcacgtgcctgtagtcccagctactcaggagtctgaggtgggaggatcaccgagtccagaaggtcaggctgcagtgacccacgattgcaccactgcatttcagcctgggtgacagagtgacaccatctcaaaaacaaaaacaaacaaaacactccacctccttttatacagaagtacctatgtggcaggccaggtctcactaacacagacctccataacaatgatttcggtactgactgagtggttaagttaaatattaaaagccagtgcccttatacaaaggctgggatgtaacaaaagcccaccaagagttttgcctaggcctttcctgggccttaaagcatgacaaaatagaaaaggaatttttaatgacccacttaggattaaacaagttttactgtgggtctgaagaaactccccagacctccacaaacaagtttatggagggtctgaaggaactccccaaacctctgtgatttagcaggagacaagataagggtaattgccccagcacctggacccatttaaattaagtaaatttactgagaccccagaggaaggtcttcagcactcagactttagatatagattaaaagaagttaatcacttatgtctttagatgaatgcacgcttacacatggacatatggcttagaaggtatataagctctggaaaactttgtaattttgagttggtctggtgataatttccaggccttctccctgtagccagttgcagaagtaaataacgtcttcctcctcggttcatctgcatctcgttattgggccacaaaactagcaggccaaccctcagtttggtccaggaacacctaggtgggacaggcacaatggctcatgcccataatcccagcactctgggaggctgaagcaggaggattgcttgaggccagaagttagagaccagcctgggcaacatagggagactctgtctctacaaaaaatttttaaaaattcaaaaaaatacaaagaagtacctacatggttaccactatccaaattgagtattatttatacattagattaataacttttaaatattgtatttcagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcaggtaagcattttaaaatcattacatgttttagtatgacagttttaattatcttgttgttaccttctaaaggtaaaagctacattagaaatatctgtttttgcccatgcatggtaggtcccaaaatagtggttttgatcctatggttagtttggagagttccacctaggtctactgccagcatgagacgcaggctaattaatatccaggagggtatttttcttgccttctctacattttctaggagaaggtaaagtagctgtgaaagcagccattaggatgggctgtgatggctcacgcctgcaaccccagcactttgggaggctgaagcaggtggatcatttgagctcaggagttcaagaccagcctgagcaacagggtgaaatcctatctctacaaaaaatacgaaaattaccttggcctgtagtcccagctactcagaaggctgaggtgggaggattgcttgggccttggaggctatagtgatccctggttgtgccactgcactccagcctgggtgacagagtctcaaaaaataaaaaaataaaaaataataataaaaaaaataaaaaaagctattaggaggtaagcttatctcaccagcctaggctggtggcactttcccacttcatatcacctgacaacaagggagggtgacccaccgcacactgatcacatggagggtggtggggaggcctgacggtaataccagaaggcagggaattaggaccttctcaggatagagctccattctagtgactgtccaactgaatatacatcaaatgtggttgttaaaaatgcacatttgagggccctattcccagcgattctgcttcaaaaaatctggggtagggccagggaacatgtgtttttaacaatggagctggctgattgatatgtaggtgttcaaggaacccacttgaagaaacactgtcctgagtaccaccaacctgtgacacctcttttggatttcttttctttctttctttctttttttttttttttaagactggatctcactatgttgtccagactgatgtcaaactcctggacttgagcaatcctcctgctttggcctcccaaagtgctggggcctctttgggcctcttgagctattttcatttggataccagagttctattgcagaagacacttgtggagcatgaactgctttccaggacatctagaattcctattaccctgtggtggttctttatttcctctatccctattccttatcactgggttcttccctttttctctttcatcacctttagcttcctttcttccctgttggtccacagccagatgctgatgtgataacatcatcatttttaaaatggaaagtgaaaaatcaataatatcaattgttttcccttttttagcagaatattatcatgtatacttggtcaaggacggataaataaaaatgaaaagtttattggatgaaacagttggaaagctacagttataataatgttggttccaagaaattttatgaatagcctaattcagtgataatatattgaacttggaattgttttttaaaatttaatttggaaatgaaatttatttatatttttctagaaatgtaagagtgaacagacctaagaaagaatgggaaaggactgattttccttaaaataaaaggaacagatgtctccatttaactctctaaggaaggaattctgttccttgagtggttggatttcagggtgttttgtttaagctgtttatctgccattttcttcctacctctttgaaataaaaaaatttatgaacagaaactccttgttgaaaaggaagtccaaattctctttctgctagtctctaatattgaatttatgagcttaatatcatgtacaaaatgaacatatgaacatatatatgttgaagagaaaatattgtttttgttagattaaaattttgtttctttggttgatattaaactgaaatttatatgatacatgagatttgaaacttagaaaaagtaaatgataaaatttttttttatttttattttttgagatgcagtctcactctgtcacccaggctggagtgcagtggtgcgatctcggttcactgcaacctctgcctcccaggttcaagtgattctcctgcctcagcctcctgcatagctgggattacaggtgcctgccaccacgcccggctaatttttgtacttttagtagagagtccatttcgccatgttggccaggctgttctcgaacacctgacctcaagtgatccacctgccttggcctcccaaagtgctgggaatacaggcctgagccacagtgcccaacctgataaaaatttaatatagttaactattcattgatatgtttattgacttcatcataagctatatatttaattaaaaatcaaactatgagtctgcaaaccagatgctatcaagcaaattaccatccatgatccataattctttttatatttttaactcagacaaatatgtaagattcagtaagttttaatgtttcaaatgttttccaaaaaattatcagaagctcccagttataaaatagttggagaatccattcaccccaaatgaactacctgtttgtgtgtgaggtagcaatcttctgtgacactattacccttaattcatatgaattccctcttcacatgaagagtacagacaacaaacagggacagatgagtctcattattcattgactcttggtgttttcatagtgtgttaaatgcctgatttcaattttacagcaacaaaaaataccaatatttattctgaaaggtaattgtatgttccaagcagccgatattaacaacttccatcacgactctaggaataattcgcagttctgaaccatgttttagaaaaacatttccagcaggtctgtgcaggattttttcctattccatcattggtaataattgcacttcttgcagcaggaacttgaaattcttctgttgcaaactgtaagactgctgtgaaaggtgtactttcaggaacagagtactttgtacgccagccgcgggtcagacctcagagtgatcttaaaggaaacctttgacatggtggcgccgggaggaacccagaacccacgccaactccgcggagcaaccccacttcctccacggtgccggggaccacaccgccccactcacccttatccagtttttaaagtgtgtgatgaaaattggttactttggagttcctttttttcttcttttaatcattccatagattaacgggtaaaaatggagactatgcgggttaaggaaagagactgggaagcagcccttgagatctccacagaacctcagggttccatggaacccagcctgcaaaccgctggtctagatgatcctaaataaggtgctaactctaaaacttatttatttctttttaagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaaggtatatagtaataccaattttccatagatattgttgagacattctatatatgtttacttcacttatcggaaatcctaggcttcttgtttgtccgtaaagggcttttagtgtcaattaggcaggattggttgctttttacacccaggggaacattgcgaattcgcgtgtgtgtgcgtccgtacatgtgtatatttaaattgattaaataatattctgtcctattaaaaaacctataatttaatcatcttcaataaatagtgctgtataaacatgtttatttgtaattttttttcttttttttttgagatggagtcttgctttgttgcccaggctggagtgcagtggcacgatcttggctcactgcaacctctgcctcccaggttcaagtgattctcctgcctcagcctcccgagcagctgggattacaggtgcatgccaccatgcctggctaatttttgtatttttagtagagatggggtttcaccatattggccagacttctcgaactcctgacctcaggtgatccacccacctcggcctcccaaagtgctgggattacaggtgtgagccaccatgcctggcctatttgtaatttttttgcacctccctgattatttcctcaggataaattattataattcaaattgcttggtcagatgtggttgctcacaccacctgtaatcccagcactttgggaggctgaggcagaaggatcacttcaggccaggagtttgagaccagcctgggcaacataggtagagctgtctctacaaaaatataaaaattagctggacgtggtggcatgtgtctgtaatcccagccattcaggaggctgagacaggaggatcgctttatcctgagagaccgaggctgccgtgagctgtgatggtgtcattgcactccggcctgggtgacagagtgagaccctgtctaaaaacaaaaagcaagagaaagagaaaaagaatttaaattgtttgatcaaaggatttgaatatttttaagccttttcaaacatatgttctcagaaaagttgtaccttcatacaccacccccaacagtgtataagaatgcccaagccaggtgcagtggtgtgtgcctatagtcccagttactcagggaggattgcttgaacccaagagttcaaggccagcctagacaatacagagagacctggtttctttattaaaaaaaacaaaaacaaacaaacaaaatgcccatttttaggtactctttgctggatactgtaatcatttttagtcaattaaatagttgaaaaaatggtagtaccatagtcccttcttatctttggggcatactttccaagacccccagtagatgcctaaaactgcaaatagtactgaagcctaaatataccatgctttttcctctatatgcatatctatgataaagtttaacttataaattaggcacactaagagattaacaataaaaaacagaacaattataacagcatactgttgtaagagttatgtgaatatgagctctctttctctcaaaatatcttactgtattgtactcacctatttttggatggcagttgactgtgggtaactgaaaccacagaaagcaaaattacagataaggggaggactattgtagtatattttttgattgctagaaaagttgagttatttttcatgaatctgtcacttaaatttcttcttaaatatttacagatttcttttaatcagctttattgagataaaatttacattccatataaattaccaactttatagtgtacatttcactgagttttgacaaacgtatatgatacagaacatttccatcaccactaaaagttttctcttgcccatttgtggtcagtgtagaccccactgcctggcctttggcaaccactgaactgtcagcatagttttgccttttctagacttgcatataaatgtaatcatacagtatgttgtcattcctgtgtgtcttctttcacttatataatgcttttgagattcatctgtgttgttgcatgtgtccatagtttgctcctctgagttgctaagtagtatgaaattgtatgaatatcccacagtttgtttacccacttacctttgataagacccgcagtggatgcctaaaacctagataatactgagccctaaatatactatgttttgactgccaaaatgttttccaaagtggctgtaccattgtgcaatcctgacagcaatatataaaatttccacctgctttacatcctggtcagcacatagtattgtccgttttgttagttttagccatcctaccaggtatctcattgtggttttaatttgcgtatctctagtgactaatgatattgagtgtcttttcatgtaacttctattgtgaggtgtctttacatcctttgcccgttaaaaaaaaattgccttgtgttcttattgagttgccaaataattgttctttatcagatacgttgcttttttgcccaggctggagtgcagtggcaccatcacagctcgctgcagccttgacctcccagactcaagcgatgctcccacttcagccttcagagtagctgggaccacaggtgtgtaccaccacacctggctatttttttttttttaattgtttgtagagacagggcttcactatgttgtccaggctagtcttgaactcctgggctgctttggcccctcaaagtactgggattacagcatgagccaccatgcccagccatctttttttttttgttgttgagacagagctttgctcttgttgcccaggctggagtgcaatgacacagtctcagctcattgcaacctccaactcccaggttcaagcagttctcctgcctcagccttctgagtagctgggattacaggcatgcgccaccacgcccagctaatgtcgtatttttagtagagacaaggtttctccatgttggtcaggctggtctcgaactcccaacctcatgtgatctgcccatctcggcctcccaaagtgcggggattacaggtgtgagccaccacgcccggcctcttttcatttttttttaacagtatctttggaagagtgaaagttttaacttttgatgaaatcttttttttattgtttgggcttttgtgttttatctaagaaatctttgtttaatccaggacatctaatttttctcctaggaagtttatagttttaattcttatatctaggtctataatcagttttaatttttgtattggtgtttgaacaaaaagtgttcaagcaccatttaataaaatattatctttaaatttcttggtaccattgtcaaaaatcagttgaccaaagctgggtgtggtggcgcatgcctacagtcccagtttctctggaggctgagacaaggggatcacttgagcccaggagttttaggctatcatgcactattaccaagcctgtgaatagctgcttaactctaggctggacaacacagcaagacctcatctctaaaaaatcttttttaaaaaatcaactgggctgagcacagtggctcacgcctataatccagcactttgggaggctgaggcgggtggatcacttgaggtcgggagttcaagaccagactggccaacgtggcaaaaccccatctctactaaataccaaaaattagctaagcatggttgcgtgtgcctatagtcccagctactcaggaggctgaggcacaagaattgcttgaacctaggaggcagaggttgcagttagctgagatggtgtcactgaactccagtctggatgacagagcaagactgtctcaaaaaaaaagaatcagttgatcttatgtgtgggtctatttctgactctttcaattctgtttcattattttattttttatatttatttatttattttgtactccttgaggagcaaggctaccccctaggcagcctgcccacagtagcctgtttcattattttaaatgtccatctttactccattaccttcttgtcttgattacaatagttttacagtaactcttgaaatcttactgtaataagaggctggaaaaaaaaaagagactggaggtagtacaagtcttccacctttgttctttttaaaagttgttttggctattctaggtcttttgcttattacaaaataacttgcttgtgtttgaattgggattgtgttgaatttatggatcaattttggaagaactgacatcttaatattgaggtttcggatccatgaacattgtatatttcttcattcatttaagtcttcaattttttttacagcaatgtcttatagttttcagtatgtagttcttgcatatttttgctaaacttattcctaagcattatatgtagctcatgctattataaatgttaatatttttataatttcaattttttgctcatcctgtcatctcagttatgaaattttgtttttttattatagtgaaatacatattacataaaatttattatcttaaccagttttgagtgtacagttcagtagtgttaagcatattcacatggttgtgcaaccactcttcagaactttttcatcctgcaaaacaaatgctatactcattaaacaacaactccccattttccccactcccctgtcccctagcaaccaccattctattgctgttcctataagtttgactactttagatacctaattttaatttcaatttttaattatacaagtttgtatttatctaattgctttttcatattgacttcatatcctgcaattttgttaaattcatggattagttctaggaatgtttttgtagattcattggattttctacctgcaggatcatgccatctgtgaaaaataagagatgtgcttcttttccagtctgccatttatttatttatttatttatttatttatttatttatttatttatttattttttacttgctttattgaactggctagaacctccagttcagcagaagtggtaagagcagatcctcgcctatttcccagtcttacagggaaatcgttctgactttcactgtgaaatataacgttagctttaaattttgtgtagatgccctttatcaagttgaagttttcttctgttccttgtttgatgagaatttttatcatgaatgggttttgaattttgtgaaatgctttttctgcatttattgagatgaacagatgattttctttgtagtctgttaataaggtaaattatgtagattgttttcaaatattataccaaccttacattccaggataaactctacttggtcatgatatatcttttacaaatatattcctggatttgatttgctaaaattttgcgaaggatttttgtgtctatgatcatgagagatattggtcaatagttttattttcctgtaatatcactgtctggttttggtagcagggtaatgctggcctcataagaggagttgggaagtattgtctcctcttctgttttctaaaaaagttggtatatgattggtattatttctttcttaaatgttttcaattcattgttgacactgtataggcctggagttttctttgtaggaaagattttaactgtgaattcaatttttcaaatagatacaaggctgtttaggttatctttagagctctctttctgtacggcttcctcctttctgatatttttttcccccgaatcctcacagtcttggcctccctaacgtccaaactttgtctgctgaattcagcaagaccacagggttctgtctgggtacttttcctgtgctgcagcctggaaactgcagtgagttggagcaaatgtagggcttacctcatttgttcacccttctttcaagaatcactgtcctgtgccacctgttgtctagtgtctgaccaccatcactccatatatcttacccagttttctagaatttaggtaagagagtaaatctagttcctgactccgtcaggccagaagaaatccctttattgatttttctttttttttttctgagacggagtctcgctctatcgcccgggctagagcgcagtagcacaatcttggctcactgcaatctctgcctctccagttcaagtgattctcccgcctcagcctcccgagaagctgggattacaggcacgtgccaccgcgcccagctaatttttgcattttttctattaatgtgtttctcattgttttgtaagagttctgtactgtatattgtaaattttcctctagcttgttgtttaccttttaaatgttgtgtgtggtgttttttatttttttaaatttttatgctatcctcttaattttattctttaagaacttttcattggcttttatagttaggaaggttttctctccaccagatacatatttacttatattttctcagagtttcttcagtttcattttgcttaagaaattatttttgggctgggcacgagtggctcatgcctgtaatcccagcactttgggaggccgaggcaggcggatcacctgaggtcaggagttcgagaccaccctggccaacatggtgaaaccctgtctctactaaaaatacaaacaatcagccaggtgtggtggtgcatgcctgtaatcccagctacttaggaggctgaggcatgagaatcacttgaacccaggaggtggaggttgtagtgagcaaagatggcaccactgtactccagcctgggagacagagctagactctgcctaaaaaaaagaaatatatgtgtgtgtgtgtgtgtgtgtgtgtgtgtgtgtatgtgtgtgtgtatgtatgtgtatatatatgtgtgtatacacatatatacctcgcagatgctagagaaccagttttttggtttactttattttatttatatttttctggggttaaaaacaattttaaaacatctaaaaacaatgttgaggtatatgtattctgtaacttagaatgctgctttttaaactttcagccttctcattttattggcttgagctcaaaaatatggtaattaatctaccagtcaaaaatagcactttatgtccagactttttggctttgttttcaggatgcagacagcttgattttagttgaagagcctaggtttttccccattgtgtgtctttgctcttcttgaccacttctttttttttttttttttttttttttttgagatggggtcttgctctgtcacccaggctggagtgcagtggcacaatcatagctcactgcagccttgaactcttgggctcaagtgatcctcctgattctcccaagtagctgggattacaggcattcaccaccacactcagctaatttttttgtagagacaggggtcttgctgtattgtccaggctggtctagaactcttgttggccactttgcaagttagtctccttctcacttgcctttctttcatactttgtttgccacttgtccccttttctccattctttctcgctcccttcctcctctataagtcttcctcttatcttttaccattcttaccttattgcttttctttttcttctcatatttctcctctttgcccctttccaccctccctgccttctatacagatagaacagataatatagttgttgggtttttttgctgtatcccagtgcttttaagagtgtctaacaaatattagaaccctcaatacatcttttctgaataataagtaatacagtttcacagataataaatctcttactcaattttttttctggcacctgtgacaatttaataaatgttaagaacctactatatgtcagacactgaatcacaaagatgaaattaagacataggccctgccctcaaggaatttacagtataagaagagagactaacaatagatgatttttaaatctttatgctaatgtattatggaggagaagcacttttagcccaactaggaagttctgggaaatcttgctgaaaagaatgatgaataaggtattgcaagataaataaaagtaggaagggcaacaacaatgtatatatacttaacaagactgaactgtagacttaaaaatggttaagatggccaattttattatgttatacatatttaccacaatttaaaataaaaggtaggaagtatgttccagatagtgaggatggcatggatcacattgtctaaaaaattgactcataggaaactatgataaatatagctgactcttgaacaacacaaggagttaggggcgctggctccctacacagtcaaaaatctacttacaacttttgactcccccaaaacttaactattgatagtctatcgttgactgaaagccttaccaataacatgaacagttgattgacatatattttgtatgttatatagattatatactgtattcttacaataaagtaagctagagaaaagaaaatgttattaggaaaatcataaggaagagaatatatatttacaatgtattaagtggaagtggatcatcataaaggtctttatcctcgtcatcatcacattaaataggttgaggaggaggaggaagcataggaggtgttggttttgctgtctcaagggtagcagagatggaagaggtggaggagatgaaaggagaggcaggtgcacttggtgtaactttatagaaatcaatcataatttctgtctgacttttgctttttcatttccctaaaaatgttactatatggtaccaatccttcttccaccgtttgctttagttttagtccccgtatcacagagggtagatgttgtgaaagaagtcaaaaacagtcttgtgtaatcggagcccttctgccagattgtctaatgttagtttattttctggcattgcttcttctatgtcttctcattgtctggcactggttcagaagcacttaccttcatgaagtcatcttctgttaattactgtggtatggtgttagcacttgaatttctccaacttccatatcttgaaacacttcactcccaactttttttggcatattcataatctcttttatgatttccttgatttactctattgtaaatcctatgaaatcccggacaacatctggacagtttttttctagcagggatttattatttcatggcttttttttttttttttcttagagatgggatcttgccatgttgccagggctggaacgtaatggctattcacaggcagggtcatagcacacagtacagcctataactcttgggctcaagcgatcctcctgcctcagcctcctgagtaagtggggctacaggtgcatgtgccaccactcctggcttaatggctttttctataataatgatggcatcttcaatggtgtagtccttctagacgttcatgatgttctatcagggttctcttctgtagtgttgacaatcctttccatagagaagggcgtgcagtgaagttcttttttttttttttttttgagatagagtcttggtctgtcgcccagcctggagtgcagtggctcgatcttggctcactgcaagctctgcctcccaagttcacaccattctcctgcctcagcctcccgagtagctgggactacaggcgcccaccaccatgcctgactaattttttttgtatttttagtagagatggggtttcaccatgttagccaggatggtctcaatctcctgacctcgtgatccgtctgcctcagcttccaaagttctgggattacaggcataagccaccgcacccagctagcacgcagtaaagttcttaaagatctttgtgaccccctgatctagaggttgaattagagacgttgtgtttaggggtaagtagaccacttgaccccttcggtcttgaactcatgggattctggatggcctgggacattgtccaacatcagaagaactttaaaaggcagtcccttagtggcaaggtacatcctgacttcaggaacaaagcattgatggaaccaatacagaaaaagtgttcttgaaccaatacagaaaaaggccttcttgttgtacagccaaaagactggcagctgatatctatcttttcccctcaaggcttgagggttaacagctttacaaataaggtcagtcctgatcataaacccaactgagtttgcacaaaatagttgagtttccctatcccttcctgccttaaatcctggtgcttgcttctgttccttactaataaatatcctttgtggcatttttttccccaagaatacagcacttttgtctgcattaaaaacctgctcagacagatattctttctctttattgattttctcaatggcgcctggaaacttgtctgctgccttttggttgggagaaggtgcttttcctgttctcttgacattttaaaagccaaacctttttctaaaattcaaaccatcctttgctggcgttcaattcttcagctttataggtccatcatcttccttttgctttaagttgtcatataatgactttgctttttctggaatcatattagagtctataggaatgtctttctttttttttttctttctttcttttttttttgagactgagtcttgctctgtcgcccaggctggggtgcagtggtgcaatctcggctcgctacaacctccgcctcctgggttcaagtaattctcctgcctcagcctccccagtagctgggattacaggtgcccaccaccacacctggctaattttgtatttttagtagagacggggtttcaccatgttggccaggctggtctggaactcctgacctcaagtgatctgcccgcttcggcctcccgaagtgctgggattacaggcgtgagccaccacgcccagccaggaatgtctttattacatcaattttgcacccacatgaaggctgcattttcaataaaagataaaaaggcatttcacaagaagtgcaaagtctttgcacctgatggtgtagccgcagtgatgcaatgatggcctcataaatttccctctcctctcctctcctctcctctcctctcctcttctctctcctccctctccccttccccatacccctccctctccctctcctcctccccctccctctctccttttccctcctcctttcctctccctctcctctccttctttttttcgtttctttcttttttttcaatggtccttactctggattcatttattttgaaatggtgggcaactgcaatggtagcttatgccagatcttaatctctggcacatatcaagcaattcagctttttcttgtaatatcatgtgttctctctgcttcttgggagcacttccagcatcactagtgacactttatatgggtcccatggtgttatttaaggtttacagtattacactaaacatcataaaaatatgtgagaactgtgagagatcactttttatggcaagatgcagtttactagagacaaactgctcctgcagagatgactagtgtcacaaggcattttaagcagatacttgtaactcttaagcttaccacaatagcaacaggaggtggctgtgaaattattacgtattatagtgtctcctacagtcagttttatgcagctatgatttaatactgcatcttcatgtctttttttttttacatttctctttactgtgaatggtgccatttatggtctgtaagtgtttgtgtgggtaagttttgataaattttaactttttataacttgtgtatactttatggtagtaaatgataaaacagactagtatctacatatattttatgcattcatgaaatacctaactttatcttaatttttttgatatttctaattcatctgtgagttttttcaaatcgtcacaaatctccaaaaatttttccaatatttttactgaaaaaaatccacatataagtggaccaatgcagttcaaacttatattgttcaagggtcaactatagttctttcttatgcttggttataattatttcaaactatatatttacccttttctctattctcagagttgggtatcagaaattaaaaaagaagaagataaaatgcactttcatgaaactgagacatttccagcaatgaaagataatttgcctccagttcgtggttcaaacagctgtcttcatgtaggcaaggtaggcttctttgatatctttgtgggtggtagcaggagaggattgctgctgtttattaaggggcaatctcagtttaattggagcagcctatgtgtgatgtcctctaggagaattggggagtttgttcagctggctgggaactatcggctgggaactatcacgttctttactgtctcattacttggaaatcaaaatgaaacagttttttcctttgaagtcctgcatcttgggcttatttactgcctttagtcttttttttctttttttatacaccctgtctcttccgtccagttttgatgagagcaaaaggtctgattcagtgtgtgaaaatttcagggaacaattgtatatatctagtagggctacagaggatatatcatgttacataatttaattatggatttaaaacagtaaacagatactttcagtacttataaatgtcattcctctgtttagtgcatgttttttcctcttattcccatttctctgtcgttggtccctattttgtcacatagacctctcctttttaatctgtgggctccacagagaaggggcctcttgaagttccaggcccattctatttaactttaggttgaaactggggttcctggcatccatctgaccttgtaatttctcagatgactccccaagccttttcattctaggttaactcattcttgttattctcgtcttttctttgaatcaattttattttaaaaacatccatggctcttcatcactctgctctctgataatttaccttcctggatctttttactcctcattaggaattatgcaggtaatggaggtgtacagtaatctggtgaggatgccactatctgcaatcagtgaaattgtatttattgaatagttggccaggcacggtggctcacgcctgtaatcccagcactttgggaggctgaggtggatggattgaggccaggagttcgagaccagcctggccaacatggtgaaaccccatctctactaaaaatacaaaaacattagccaggcatagtggcatgtgcctgtaatctcagcttcctgggaggctgaggcacgagaattgcttgaacccaggagatggaggttgcagcgagctgagattgtctcctctgtctcaaaaaaaaaaaaaaaaccacaaaaacaaacaaaaaaactctgggcatggtggctcacacctgtaatcccagcaccttggaaagccaaggagggtggatcacttgaggtcaggagttcaagaccagccgggccaacatggtgaaaccccatctgtactaaaaatacaaaaattagccagccatggtggtgggcccctgtaatcccagctatttggaaggctgaggcaggagaatcgcttgaacctgggaggcagaggttgcagtgagctgagatcacaccactgtactccagcctgggggaaagagggagaatccatctcaaaaaataataataacaataataatagtcccggtgtactaagactgtgccttgaaaatataacaatgaacaagcattgctgaaggagcaatggggtggatggactagtggtacagtagttcttaaagtatggtctaggaagcccttgaagtcccagagattcttccagggggtccagaaagttagtgctattttgaaaataatactaatgctttgtccttgtcactgtgttggtatttgccctgaggataaagctgctattgctttaacatgaagcaaggcaggcaccacgttgtatatacagtaaaaacaaattccaattttacttaaaaatacctttgataaaataatagaatatttactttgttagatcttgaacttccaggacatgtcattttagtattttgtgacaaagtgagaagtatgcagaaagcacttccctgcatagtcaaatatgatggttatgatatgatgcatagccacgtcttcctggaatgctgtttttacttgaaataatggttgacaaactgtcattattcagacttaggattttggcaaaaattttgttggaagtgaatgaaggaggcctgtcgctttaagaaaaacaactcacagtatttgttgctagtaagaaaatctgacctttcaagtgcaaattaggtccaggcacaggcgggcagtggctcatgcctgtaattccagcactttgggaggccaaggcgggtggatcacttgagcccaggagttcgaggcctgggcaacatagcgagaccccatctctacaaaacatttttttttttattagtgtggtgtggtggcacatgcctatagttctagttctatctattcaggagactgaggtaagaggattgcttgagccctagtggtcaaggctgcagtgagccatgatgacatcactatactccagtctgggcaacagagcaagaccctgtctctaaaaacaaagtgcaaattagggcttgaggtattaaatatttagtataatataacaatatctaataatttagatattatgtgtttctcaaatatctgcttgtgacagaaaatagcccttaagggggatacttgtcaaaggacaaaattacaacaaatttcaagatctaattggcttctattaacaattcatgaatcaggatggcatctcctctaaaaatttagaaaatatgctccaatggccatggcagaacagctggtttttataaggtagcttgagcagggataaggcatacaaaaaatagactatttaataacaggttactttccttgtaagggttaaagcagaaatttggctattatctctgtctcttgatttctccagtcagataagcaacttagttttggtttggtgatatggaacttgagcactagtgactgtatttaagtctgttggggcctagtgcaggagcttagtccaaatcattgaccttctataaattttatttaacatacttgaaagtcttttttgatgatctccatgcagatattaacaaattgtgatttttaaaattgcataatgaaatctgtgaatatttggaaaatctgtataactccaatgaccaataattttgaggagtgcgagagtgtcatgatactgaaaagtttgagccccactaatgtagcatataatggattatgacagtaaatatgcagtgttatgagaatacatagaaggcacatgtcccagcctttcaaagtcagggagcattgccttcttaaaatatccaaatataatattacacattagaatttatcatgtatactgagtccatgtcttgagacttttattgctccacattctttttttatttattgaaaatcttcttcttctttattcagtcataattgataaaacttgcatgtatttatggtgtgcaatgtgacattttgatatatctacacattttgaaatgcttaccacagtcaagccaattcatgtccatttcttgatccctaaagggggatattttttgtcacaggtaggtatttgagagccacatatgaatattaaatacccctgattttgaatcaatgaccttttgaaactaagtgataccacttgtattagtttcctagggctgctgtaacaccacaggaagtggttggcataaaacaacagaaatgtattctttcacagttctaggggctagaagtacacaatcaaggtattggcagggcctttcttcctccaaaacctgtaagggaagatccttccttggctcttccagcttttggaagccccggccttccttggtttgtagcggcacaactctaagctctgttttcatttccacaccaccagcttccttctattggaacttcttctcctctttgtataaggacacagtcatactggattagggcccaccctaatgacttcatcttcatttgatgacattgcaaagaccctatttccaaataaggtctcattcacaggtaccggggttaggacttcatcatattgtttttgggagacacaattcaacccataacatcatcttagcattgagaacattgtctttatgagtaggaaatcgagttcaagcatcaaatgatactttttgagcctgtaaggactgcatagtactcatttatgtagtttatatagttcttagtattgctattagcaaacctgagcctaatgagaatgaagatatgtaatagtttaaaaacaaatcagtacctactttattattataaattctgctatacttacctttcttcagactatatagataaatattttaaagttaatattccttagtacttatctagcaaaaaattgtaccctctctgggagactgattatttgtgagcattatggctattgtttgcctttctctcattctgttctggtgcagaacctgccctctgtctttagcagtgggaatgtggctactttgggccactgttagtgcttggttaggatgggcccatgacccaagctagccaatcagtccttccttggaatttctctaactgaagatggagagaagagtcactctccttttcctctggtggagagagctgtgaggttataattccagaatgcttgtggtgatgtttcctgccacatggagaaagcaagtacccatcagggaaagtgaaatcagtaggtagagaggagcagaacctgggaggggcagggagagctggagaaagggcataggaatcccctcatccagcagcacccttgcccttccatcagtttagttatataagctgataatttcttcttttttaatgtaattattccaaatcagattactatcattgcaaacttctgactaatatagcaattattcttgtttctccaatgcctaggtttgaaaagaatgaatcagaatttagtacttttttattataagaaaatcagtaataatcatattcacacataagttttaaaattttatatgtatatacttaaaaacctatagattgtccccagaattaactataaatttaaaattctttcttttacatgctgtatattattatgttaataactgtaatactgaagttattataacttccagggtacctatttttcttatccattccatttgtatatctttattttatttttatttttttgagacagtttctctttgtcacccaggctggagtgtagttgctcgatctctgctcactgcaacctccacctcccaggttcaagcaattctcatgcttcaacctccaagtacctgggattaaaggtgtgcgccaccatgcccagctaatttttgtatttttagtagagacggggtttcaccatgttggccaggcgggtctggaactcctggcctcaagtgagctgtccacctcagcctcccaaagtgctgggattacaggcgtgagtccccgcacctggcttccatttgtatatcttaacccaatactttccattgcatttacagtaaaacctgataatcttatattaaatatgtctcataaaatatgattttattcttttaggaaaaatattctaaaagaccaactaaaaagaaaactccaagggattacgcggaatgggataagtatgttttacatgtctttatataaaatgtatcactaaaaaagttatctaccacaaaatactgcaataatttcttaaataattattataaaccttaacatgtcaagaataccaaattacttcaatagagtactgagaatatctggcctcagcacttttgatgtttttttcagtacataaaaaacttctacatcctatttttttataaagtcagccaaaaaaactaatgtattttttatacccatccaaactaaaaaggaacaaaaatttaaaattgagataagttagtcaaaattttaatttcaaagttctgaccagtttagatttgattaacgtttaagttctcactaaattgtatgttttcttaagaaggaactcagatgacttgaactattaacttactacatatttttgaatatgtatccaaaggcatacttgtacaaatataagaatatcaatgataaatttattttcttgcctgtattgtacttttttggtttttattgttctttcatttaagatttgacgtggagaaggaatgtttaaaaattgatgaagattacaaagaaaagacggtaatagacaagtcacacttgtctaaaattgagacaagaatagatacagcaggtaattggagaaaaaataataatttagtagtctttaaagtttttcaattataataaaaagtgtcaatctagaagacattgtctttgagtactgcacagattaccatgaaaagtttatggattttctcttacagttgaccactcaacaaattcacttctctcttttacccacttaatttttaaatgtagtaaggctttaaaatataaacctatttttcttactgtaattcatttgtttttaattccttttttccaatcctctttttcctccaaattcctaaaattgttttctttttgcttcaaaacaaaaagatggggcagtttattggactagcacctataaagtgaaacgaaatcaatcattaaaaaaattctgaatcctcaaaacttgtgaatgatttaaaaagaaaacatccctaagcttggggaaccttttattttcttttgtttattttatgatctttctgctttcttctgcttctgttaaaataagcattcttagatttaaacttgaaaaattctgttaaattatacgtttacatatagcagataacatttatttctaggtctaactgagaaagaaaaggattttcttgccactcgtgaaaaggagaaaggaaatgaagctttcaactcaggagattatgaagaagcagtgatgtattataccaggtgagcagatgtttgttggggtttaaacttgccttttaaaaaatgataatgttttaattgttgaaacaatataaataagcgaaagtctatgtcagaatctctcaatgtattgtacttgtgatttatcatatattcacttgtgtttctcctattttttcaataatttttctcaaacctctaagctcccactccactcctacttttgacagaagacttaacttcctatcttgcagagaaaatagaaggcatctgacaggaattcaacagaaggcccatatgatatagaagtgaataacttgggttccattgtagactgcctggatttacttctagtactttggtgctccttcctaccacagggcctttgcacatgctgggtgcaccatcaaaaatgcttttcccatggctggtctgagtacagtggtgtttacaactaattgatcacaaccagttacagatttccttgttccttctccactcccactgtttcacttgactagcctttaaaagagaaaaggaaattaagaaaaaaaatgctcttccctcgttccattatctagttaattctgatttatccttcagatcttagtcttcaccttacttctttggagaagtcttacttcaccttccaaactaggttaaatctccatctcaccccacccacctcacctcccaatttataggctcttatagcagtcttacctctcctttgtagcacttgtcagaagtataatttaagcttgtgtgatttgataataactagaatgtaagatttgtaacagcagaacccatttgtcaaggatttttacaccattgtatccccaaggcccaacaaagtacctggttcatagtagatgttcaataaatatgtatatgaacttctgaagttcttaacagcctatgaaaagtagactaagtttttaaaatgttgttacagataaactgttcttatagaatcactaatgctaccttagcactaaactctgtacaatcttttttccacctttggaaataagatagatttttttcaatgttgttggtgtatctaaagaagttttctcagattgtttaaatgaagatacgaggtaaagaggatatatgatggatcattcattcagtacagcctcccctgttcaggcaggtggatgtcagccttgataactgttctttcttttcttgtaggtttataccagagattctcttgtctattacaggttacaaagctcttttcttcttttttgaggagtcatatagttgaagaattaaagcagcatagtatgatggttaagggaattcagactaccactttctgaccttgggcagattctttttttttttttttttttttttgagacagggtctcactctgttatccaggcaagagtgcagtggtgtgatcatagctcgctgcagcctcaaactcctgggctccagggatcctcccacctcagcctcctgagaatactgggactacaggtgtgagtcaccatacctggataattttctcttgtgttttttgtagagacaggctctcatgatgttgcccaggctggtctcgaacctctggcctcaagccatgctgtcacctcggtctcccaaagtgctgagattacaggggtgagccaccatgcctggcttcaaaaaatgtgtttggtatttgatatttgatgttaacttacatcaacggttttttttaaagtgatctataggtatttatctttttctaccttcattttttattccagtaactaaagctcagattccagatctatcagtatttaaattcccataatgcctctaaagcctgagttaactttaaggctattaactggatatttaagcatctgtttaaatattgatttagtatgcttgtagaattgtattttattatttttgataatataggctgtatttgtttgctaaggttgccgtaacaaagtaccacagactgagcggcttaaacgagagaaatttcttttctcacacttctggaggctggaagtttgagatcaaggtgctagcagggttggttttttcaaggcctctctccttggcttgtaggtggccgtcttctcccagtgacttcacagtctgtccatacatgtatgtccaaatatcttcttcttataaggaaaccatttttatgggatctgggccccctctcatgacttcatttcaccttaattagctttttaaagaccctatctccaaatacagtcatgttctgagatactgtggggttaggacttcaacatacgaatgttgggggatacaattcagcccatagacaggttataattgttttatgtataactgaagctgaatttctctacattcttatgtttaccttaggcttgcttgttgccagtaactgtttcttttctaggagcatatcagcgcttcccactgtagttgcctataacaatcgagctcaagcagaaatcaaattacagaactggaatagtgcttttcaggattgtgaaaaggtcttggagttagaacctggaaacgtaaagggtaaaaaatattatagaattcttttacatttacagcaggatccattaataaagaccatttgtagatacttgtaatgtttacattaaaaatatttcagataaactcaaatttctgtatgtgaatcaccaacttcataaagttgcttttaaattgaacttgtaagttaagctcctgattatttgtactgaagtagctaataatcccagaggatttaataaaatacatatatattttaaagaagtatctcaataaacaaaaaaccaacaacaacaaaaataaaataaaagagaagtatcttggccaggcacagtggctcacacctataatcccaaaattttgggaggccgaggtgagacgattgcttgagtctaggagtttgagaccagcctgggcaacacagcaaaactctgtgtctcaaaaaaaaaactcaagcttgcatttgaacattctttttctccaaaaaaaattaagtataacttaatatagattttctggtatttataaatataataaaataataagcccacactggacctctagaaccttctcccagcttctttgtggatatttccacctaggtggctatatataattttgtttgtttgtatgtttgtttttttgagactgagtctcattctgtcacccaggctggagtgcagtggcgtgatctcggctcactgcaacctctgcctcctggattcaagtggttctcctgcctcagcctcccaagtagctgggactataggcgtgcaccaccacgcctgactaattgttgtatttttagtagagagacggggtttcaccatgttggccaggctggtcttgaactcctgacctcaggtgatccacctgcttcagcctcctaaagtgctgggattacaggcgtgagctactgctcccagcctgtttttgtttttttgagatagggtctcactctgtcacccagcctggtgtgcagtggtgcaatcttggcttactgcaacctccacttcccagtctcaagtgatcctcccacctcagcctaccaagtagctgggactacaagcacgtgccaccacacccagctaattttgtttgtatttcttgtaaagatggggtttcactgtgtcgcccaggctggtctcaaactcctgagctcaagtgatctgcccacctcgacctcccaaagtgctgggattacaggcatgagccaccaagcctggcctgctataaataatttaattttcattttaaattaataatttgaataacttaattctaaattaaatttgtccaaaactgactctttctgccaaaaacctgcactctattttgattccctgtccctctgactgaccaccttgtcatggttcaggcctgaaatatgcaaatcagactctattctccttttctgttatcaagaaggagtcattccaagagggagtgacatacattataatagacacattatatttctttaaatttttatggattcaaataaatataaacacttttttcacatggaatgtatccctttttgcctataaacatggtggaggtggcagaagccatgggagtgctaaggggaagcctggtgcatcacctgccactgtcattgccatggattgccctccatttaccaataaagtcctgttgggcctgtgttttacgcaagctggtctctgtcacagagtatggctgggctcccagctttaggcagcagcccactgaaggttttgccaaccccataccactgctctgccaggccccgtgccaagcactttacatgtattaactctgttaattttaacaaaactctcggccaggcttagtggttcatgtctgtaatcccagcactttgggaggccgaggtgggcagatcacctgaggttaggagttcgagaccagcctggcaaacatggcaaaactccatctctactaaaaattaaaaaaaaaaaaaaaatggaggggtgcagtggctcatgcttgtaatcccagcactttgggaggctgaggtgggtggatcacttgaggccaggagttcgagaccagcctggccaatgtggcgaaactccatctctactaaaaacacaaaaaattagctgggcatggtggcaggcacctgtaatcccaacaacttgggaggctgaggcaggagaatcactggaacccaggaggcagaggttgcagtgagctgagatcacgccactgcactccagcctgggcgacagaacgagaatccatctcaaaaaaaaccataataaattttaaaaaaaattactagacatggtggtgggcacctgtagtcccagctacttgggaggccgaggcaggagaattgcttgaacctgggaggcagaggttgtactgagctgagatcacgccactgcacttcagcctaggggacaaagaaagactctgtttcaaaaaaaataaataaatacagaatatgttagcattaggtaaagctgagttaagggacacaggaactcattgtactatctctgcaacttttctgtaaatctccaatgattccaaaataaaaagttttaaaaaaggataatcattatgtcatgaatatttcttcatagaaattcccttcagaaatctgtgtagcaatagcaatagctaaattatatttaaagtgcagtgctacaattttaattaaatttataacaaaatgatttctcatttagattttcatagctcattctaacactaaaattcaaattggtcaaatttataattatgttttaaaatagcatattaaaatatgtcagataaaatttctaacttttcaggcaggcgcggtggctcatgcctgtaatcccagcactttgggaggttggggcaggcggatcacgaggtcaggagatcgagaccatcctggctaacacggtgaaaccccgtctctactaaaaataccaaaaaaaattagctggatgtggtggcatgagcctgtagtcccagctacttgggagactgaggcaggagaatcgcttgaacccgggaggcagaggttgcagtgagccgagattgtgccactgcactccagcatgggcaacagagcaagactctgtctcaaaaaaaaaaaaaaaaaaattctcacttttcagaattaccaaacttgattctttttcaaagtaatgacttattacacaaagttctccttatataatagttaatgatgagtctagagaggcattcattgtcagtattaaataattaccaaattatacattgaaacgtacccaaaaaatcaaatgcgaattatcaaagtgcttaatttctgacctaactgacttaatcatcaggattctctcagttccctatgctaagtcactccttctaatcattttagagattgctatacagatgtcactaatgagccacattctgagctagatgctggtcagtaatatactttttttttcttttttttttttttttttggagacagagtcttgctctgtcacccaggctggagtacagtggcacaatcttggctcactggaacctccacctcccaggctcaaacaattctcctgcctcagtctcccgagtagctgggattacagatgtgtgctaccatgccaagctaattttttttttgtatttttagtagagatgggattttgccatgttggccaggctggtcttgaactcctggcctcaagtgatctgcccacctcaggcccccaaattgttgggattacaggtgtgagccactgtgcctagccaatatactaaattttgataagggattttatgttttcaaaaagtggctaaataatactcgccataattataaaaaggaaaggattattatcagtgaaaatcattccgatattgcaatacaatgtgttgcctgtgaagggttgaggtatgaaatctcttagttcttggaaaagctggcggggcctggggctgccagagggccagagggttgttatagaggggacagctggctgatgtagcctcttttatgtacctcagtgtcatctcctatgtgtgtatcaacatgaaaaagggtgtagttgagctttgggtaattacatcctaaagtattctgtgctgctcatatcttccacttgccaaatatgttgtaaccataatgccacatattaaaaaacataacttttatattggtaaattttcagctcttctgcgtcgtgctactacatataaacatcaaaacaagctccgggaagctacagaagatttgagtaaagtactagatgttgagcctgataatgatttggccaaggtaagtatagaatgtgatttctcacctaattctgtagttggctgtttctgtatttattttaaagtggtatcaatcttgccaaacaaattatgttgaagatcaggtcacagctttaaaaggtaggtatattccagacaccccaaaacgttaacatctatttcaagtggaagaaagcagaatcttaaaattttttttcaaaactataaaccttcctctgaaagacaaatatcaatttttctttttcctatagtgttgtaggcaatgtttttctctgagccatgtggagtggtatagaaggtaccttcctaggtaggattaggggtgaactctgtggccattgaagagtgtttctctttgtaatgagcatggtagcatttgctacctgactgagcagactgactcagttatacacttaggggatctgtattcacgcctaaagagtagaggtaagtgtcaagaactgagattttcccctgcttacaaatgaacaaggtggcctaccagaggatacaagatatcctgagtcaaacacgaaaagactttgtcactccaagcagatgagcttcacgttcatgtcagttccccttgctcccaagtcccacaggggtgacatagagtggcccagatggatgttgcacactcaatggatttatgtgatggctgacaaatcaaaaatttaggaaaccagctgagtgcagtggctcacgtctgtaatcccagctctttgggaggctgaggcaggcaaatcacctgaggtcaggagttcaagaccagcctggccaacactgcactccaactggggcaacagagtgagactccatctcaaacaaacaaaaatttaggaaacctgcttcttttatgatgggatataagcaaacctgcccaatctctgctccatagggaagcatcacctttattacactggagagccaacacacctgccctctccgctgcagatgaatactatttctgtttgccaaggttgttctcagtacaaacatccttagagatgtccagaaagaaggtggtttagtgcctctgctggcagtatagtcagaaataagagaaacccatggaaaaattgttactaagtttccacatacacctattgggttacctatcccactgtctctgagtggcagctaatgttcctagaatatcagctgctttgtcaagtcaacattttaggtttaggtttagggcctggcttagtatttcctttttgtaatggttatgtttatttatttttgagacagggccttgctctgatgcctcaactgtagtgtggtgggaacatggctcactgcagcctccacctcctaggctcaagcaatcctgccatctcagcctcctgtgtagctgagaccacaggtgcacgccacctcccaaagtgctaggattacaggcatgagccattgtgcctggtttcaaatgcatttttatcttaaccatatgcaaagattaactcaaaatggatcatatactttttgatgtaagatataaaatataaaagttctagaagaaaacataggagaaaatctttatgaccttagacaaatatttcttatgtaagacatgaaaagtacaatccataaaagaaaaagttgatatattggacttcatcaaaatttaaaacatatacttttcaaagacactattagaagaataaaagacaagccacagctgggcacggtggctcacacctgtaatccaagcacttcaggaggctgaggcaggcagatcacttgatcccaggagtttaagaccagcctgggcaagacagctgaacttcatctccacaaaaaatttaaaaagttagccagacatggtggtgtgggcctgtagtcctagctactcgggaggcaggggtgggaggataatttgagcccgggaggtcaaggctgcagtgagctgtgattgcaccactgtactccagccggggcagcagagggaaaccctgtctcagaaacaacaacaccaacaacaacaaaacaaaacaaacaaaaaagccacagaccacagactgggagaaaatatttgaaaatcgtatatccaacaaaggatgatatatctatttttcatcagagtcagcataaaatatttcagaattttcagcattactctaaaacagtaatgtgggctgggtgtggtagctcacgcctgtaatcccagaacttcaggaggctgaggtgagaggattgcttgatcccaccgtttgagactagactgggcaacatagtgagacctcatctctatattttaaataaacaaacagcgtatgtagcatgatttcatttgtgtaaaactgtacatctctgtgggtatatatgcatagaaacatctagaaagatgattatcaaaatgttaatagtagtatctgaatggcaagattttaggtgattttttctttattttttatacttgttacaccgctttttgtgtgtgtgtgttttttttttacagtggacatctatgattacaatcaaaggccaccaaaaaaaagccttgtcttagttgtattcatttttcaacatctttatgtttttaacctgaaagaatggttatatttattattagaggaaaatattttctttaatatggtaattatgttgcagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagagtaaaatattttttctatttaggttatgtaaaaagctgccttttaatatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactagaaaattgctatgtgtgtttttcaaaaatattttaaatatgcaaaagaaataagtataatttaacacttgaaacaatattttaagagaatctagactagataaagggttatcttcataatataaaacatcgaaagttatgtcaactttgaggggaaggatttgcctcctcacatgacaagggacataaaaacttttccctccgtcagctgggcgcggtggctcacacctataatcccagcattttgggaggccgaggcgggtgcatcatgaggtcaggagttcaagaccagcctggccaacatggtgaaaccctgtctctactccaaatacaaaaattagctgggtgtgatggcatgcacctgtaaccccagttactcaggaggctgaggcaggagagtggcttaaacccgggaggcggaggttgtggtgagccaagatggtgccattgcactccagcctgggcaatagagcgagactccatctcaaaaaaaaaaaaagaaaaagaaaaaaaggtttttccctccttcttgagaacacctgagcaactggcagtggcggggcagtggaggggggagatattatcaattttgaaaatcattcacaagtaaaaatcaacttgtaagtaatttgacagaatattctaattttgagagagatacaaaatgttcagttcattcaattttaaaaataaagaacgagttttaatttttttaagtgacaaaaaataatgcaatgtatacacttcagattaaaatacaatcagttaagactggataaagacaaaggaacagaaagggagggagcgagaaagaggaagacaatcagagaggtgagaaggaagagagaacataaaaaggattgaaaagggagaaattaaggtaaccagtttttcaaggattcaggcttgccttttagccagattgtaaatacgatctggcagcaaatcttcttagggtttatattgagcttttgcataattaaccatatgtcttacagttaaaggaaaccattttaaatcttatctgaagtgagatgaagtataaactatattacttcctattattttaaaattgttattttaaaattttatatatagtaaaaatgaaccttttgaatatacagttctaatacatgtacggtttcatgtaaccatcaccatagtcaggatacagaacagttctaccacccaaaaaggccttcttgctgtcctttcagtgaaacccttccctcaccccagctcttctctattcctatagctttaccttttccagaatgtcctataaatggaactggaaagtatgtcaccttttgagtctagcttccttcacttagcatgtcactgagattcattcatgtagctgcatgtatcattgtctcattcctttttactgctgagtagcattccattaatagttgtaccaaagtttatacattcggttattcaaggacattcaggttatttccagtattcactaatcatgagtaaaaactgctatacacactcatttgcaggtttttgtgtaaacatatgttttcatttcccctgagtaaatagctaagagtgggactgctgggtcatacggcaagtatatgtttaactttattggaagttgcctgactgttttccagagtggctataccattttgcattgccattagtaacatatgagagttctagatgcttctcgtccttgccagcatttggtattgatttttttcccctttttacccattctattaggtgtatagtggtttctcatcagttttaatttgcattttcctgatgagaatctttttatgtgctcatttaccatctctatattactttttgtgaagtgtctcttcaaattattccaccaattttcaaaaattgggttgttgttttcctactgttaagtcctgagaattctttttataatcttgatgcaaagtcttaaaatttttttgtctgtagcttttttcattcttttaacagtcttttacagagcaaaggtttttcattttgtagaagtacaatttatccagtttttttaatggactgtgcttttaatgttatatcgatgaacactttgcctaagtcaaagtcatgaagattttcttgtaagtttttctttttcagagatagggtcttgctctgttgttcgggctagagtgcagaggtgtgatcatggctcactacagctatgatcactctttattattttcttccttctgcttgtttttatgttcatttgcttctctttttcttttcttctttttgagatggagtctcgccatttcgcccaggctggattcaagctcctgggccaaagattctcccacctcaggctcccgagtaaatgggactataggcacaccaccgcactcagcttgctcctctttttctaagatagtttctcaagacagaagcttggaatatttatttgagaatttctcctccaaatataagcagtggatgctataagtttctttctgatagaaagaatataatttttaagccaggcacagtggcatgcactcatagtcccagggagctcaggaggctgagggttgcttaaggccagaagttcaatcccagcctgggcaacataacgagaccccatctttttttagaaaaataatataatagaaattttaagaccagtaagttcccttttatcagaaaagtcaattgagatgaagtagaataaatagccggaaactcagacataatcttttcatcttaaaatgaaatgaaatcaattgaactagtttacattcacctctagttacattgaactagttacattcaaacaagttacatatcaaacagtcattgtttgatagagtgtgaaaagaggtgctggagccttggacacaagagaagcaaccccagtcacttttaggaaaatcatgttaaagcccagaggaaagttatcaagttggaatctttacatgtggttctccatctcatcacattccgggaaagaattcccagtcattatggggtatgttccaggaccatggaaaaaggcagcaatttgtgttttttaaccttgtctggtaatgctgtccctttatgatctccactcgggttggccaggcccagttcatcccgactggggtataacataactgatgaatttaatttaacaactgacaattattgagcacctactctgtgtcaggtgctgagataagacaattgataggctttctttgcctctccttctaagggccagtattaacaaattgcctattggccaggatgattacacctggggatttgagttcatgggctttttcctggaagctccctatctgtttgccttctctagtagagatcatttagaaggaagaagtggccattaccatacagctgtagctgtcaaagagtttggtatttattccatctatctccttacagagacgcaatcagaggaaagtgagcatctaccctcccttgcagtgctgttggtgttgctacttaaaaatgaaagctaagaaaattaaagtcactcacaaacagaagaataaatatagatcagtatttctcttgtgctagaactggcaggatcaggagagtggaagtcagggatttccaggagttcaaacaatcaacaaaatcataaaggtgaataattttgattatgtgaaaatgaaaaacgtgtatgttaggcgccataaaaaaaactaaaagacaaatgacaaactaggaaagatggcaaagggttgataaccttataatatgaaaagtttctacaaaacaataagaaaaagatgaggtgctagtacaaaactgggcgaagcatacagacaaatcactaatgaagaaatagaaatgatcagtaatctttgtattactcataaaaatgaaaatcaaatattctttttctttcctatcaaattggctgagatagaaaaaatagtaccctttgttgtcaaaagtgaggtaagataagcattaaaaatattttaatataatgcatatatagtaaaatccatccttttcaaattcagtgaattttagtatattcatgaagttgtacaactatcaccacgatctaatttcagaacatttttatcatccccaaaagaaattctatacccattggcagttactgcccattttacccttcccctggcccctggcaaccactagtctacttttgtttgtatggatttgcctatcttgagtatttcatacaaatggaatcatagtatgtagacttttgtatctgtctttcacttaatgttttcaaggttcatctatgttgcatcttgcattagtacttcattcctttttatgtagaaataatattccattgtgtagataataccagattttctttattcaccagttgatggacctttgggttgtttccactttttggctattatgaataatgctgtcatgaacgctcatgtacagatttttgtttgaacagatgttttagattttcttgtgcattattttggagtggaattgctggatgatatactaactctgtgtttaactttgaggaaatgcagactgttttccaaagtagctatcccattttacattcccacctgcaataagggttccaatttctttacatatttgccagcacttgttattgtctgcctttttggctatagccatcttaatgggcatgtagtggtaactccttacggttttaatttgcattttcctaagaactaattatgttgactgtctcttcaatccctatgggctatttctatatcctctttggagaaatgtctattcaagttctttgccttttttttgttgttgttgttgagatggattttcactcttgttgcccaggctggagtgcaatggcatgatcttggctcactacaacctccgcctcccaggttcaagcaattctcctgcctcagcctcccaagtagctgggattacaggctcccaccaccatgcccagctaattttttgtatttttagtagagatggagtttcatcatgttggccaggctggtcttgaacccctgacctcaggtgatccacctgccttggcctcccaaagtgctgggattacagatgtgagccactgcgctcagcctctttgcccatttttaattgggttatttatctttttactgttgagttgtaagcattttttatatattctagatactagacccttattaaatatgatttgcaaatacttttcccattctgtgggctatcttttaagttttttgataatttcctttgatgcagaagttttttgttttttttttagggtgcagcaactcattttgacttttttttttattatactttaagttctagggtatatgtgcacaacgtgcaggtttgttacatatgtatacatgtgccatgttggtgtgctgcacccattaacttgtcatttacattaggtatatctcctaatgctatccctcccctcactccaaccccatgacaggccccggtgtgtgatgttcctcttcctgtgtccaagtgttctcattgttcaattcccacctatgagtgagaacatgcagtgtttggttttctgtccttgtgatagtttgctgagaatgatggtttccagcttcatccatgtccctacaaaggacatgaactcatccttttttatagctgcatagtattccatggggtatatgtgccacattttcttaatccagtctatcattgatggacatttgggttggttccaagtctttgctattgtgaatagtgccacaataaacatacgtgtgcatgtgtctttatagcagcatgatttataatcctttgagtatatccccagtaatgggatggctgggtcaaatggtatttctagttctagatccttgaggaatcgccacactgtcttccacaatggttgaactagtttacagtcccaccaacagtgtaaaagcgtttctatttctccacatcctctccagcacctgttgtttcctgactttttaatgattgccattctaactggtgtgagatggtatctcattgtggttttgatttgcatttctctgatggccagtgatgatgagcattttttcatatgtctgttggctgcataaatgtcttcttttgaaaagtgtctgttcatatcctttgcccactttttgatggggttgtttgtttttttcttgtaaatttgtttgagttctttgtagattctggatattagccccttgtcagatgagtagattgcaaaaattgtctcccattttgtaggttgcctgttcactctgttggtagtttcttttgctggatgcacaagttttaaatttttatatgaagtccaattttttttttcagagccccccttaagaaagatttttttcagattttttttcttttgttgcttgtacttttgatatcatatataagaatccattgtcaaatccaaggtttaaaaacttactcctgtgttttatttctttttccttccttccttccttccttcctttttttagacaaggtcttactctgttgcccagactgaaatgcagagtggcacaatcatagctcactgcagcctctaactcctgggctcaagtgatcctcctacctcagcctcccaggtagcctggactacaggcacatggcagcatccctgcctaattttttcatttttattttttgtagagacaggggtctcacttcgttactcagggtggtcttgaacccctgggctcaagacattctcccacctcagcctcccaaagtgctgggattacaggcatgagccactatgcctgggcaactcctgtgtttttctaagatttttatgattttagctcttgtatttaggttattgggttattgatccattttaattcttatatacagtgtgaggtaaatgtgtgtggtattacatatgtgtgtgtgtatatccatatatatatgttttttggtcatagttcctgatttatacaactcccgtagcccttgttacagacttttgtcataatgctggctatctgaggcttcaggaaacaatctctccagatctcctttcaccttccccaaggcaggactctaatcttactctgcctttctgattgtgggtcagaagaccctccccagagagggtcctgccacatactctgagggaaggaatgctgacttcaaaaattttccttccgatagctgaacacagggaggttcctggaaggtgcctggccaccctaggcacctcttcctctgtaacccttgcagtatcctttgtaataagccattaaacatgttgtctggagttcagtgagctgctccagcaaattaattgaactcaaagagtaggggtcatgggaaccctaacttgaaacctgttggtgagaagttctggaggcccagacttgtaactggtgtctggagtaggagacagccttggggactaagccctcatcctgtggaatctgacactatctccaggtatatagcatcagaacttaactggaagatgctcagccagtatctgctgcttggtgcctggggataaaccctcacacatttggtcacagaagtcttctatgttgatgattattgtggtggtgtaagagtagaggaaaaacagtttgtgagagtttttccaaaagagcgtccaacttagttttgttttctgttttgtttttatttgtttttagtatgtggaaatccagttgtcacatcaccatttgtttaaaaaaaaaaacaaaaaacaaaacaaaaaaacctgttcttttcctactgaatagacttggcacccttgtcaagaatcaactggccaggccgggcgcggtggctcatgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaatcaactggccatagatgtatgggtttacttatcaactctcagttcctttccactggtctatgtgtctttccttatgccaataccacactgttttgattactctagcttttagtaagttttgaaatccagaagagtgagactgggtgcagtggctcatgcctgtaatactagcactttgggaggctgaggccagaagttcaaggctatattgagcctaccactgcactccagccttggcgtttgtgctggttaatactgagtgttaacttgattggattgaaggatacaaagtattgatcctgggtgtgtctgtgagggtattgctgaaagagattaacattaagtctggtgggcacaatctaatcagctgccagcaaatataagcaggcagaaaaacatgaaaggagagactggcctagcctcccagcagcctacatctttctcccgtgctgggtgcttcctgccctcgaacattagactccaatttcttcagtttcgagacttggactagctctccttgctcctcaagcttgcagacagcctattgtgggaccttgtgattgtgaaagttaatactgaataagcttatatatatatatatctcctattagttctgtccctctagagaaacctgactagtatagattttagtacccggagtggttccagaggaacagactattaaggatgcagttctttcgttggttttggggtttctggagttggctacttaatatgattagacccaaaaatgctaaggactctacttctaatagtatggagaatactgatagtccttggtgtgaactgtttagagagttatgcaaaataaatgcatttgacacttctgattcatcactcatgagaggcaaggagtttagtaactctatacatagtacctttgaccatatgtggagaaccaaggaacataatgaagctggttggttgctcctaagttcagtggacaaagtagtgaaagaaaatgaactcagggattctgtctctcagcttcagaagcagatactgagcctcaaatctgccaagattgccctgagtgagagtcttatctcctgtagagaaagagctgaaattgtggaaaaacagacacaagctctcatcatgcgagtggctgacctgcaacaaaaggtgcgtgcacagccttgccaggtgtctaccgttaaaataagggcattgattagaaaagaatgggaccctacaacttggaatggggatgtgtaggaggaccttgatgaaactggggacactgaatttgtaaactctgatgaacctttcttttgccagaaggaacagattccccatacccagtagtggcaacatcccctccctgatccatgctgccatcagcctttccacctttgtctgaggagataaatcctgcactgcctgacgcaacagtgatggcctcccgagacagttgccaggcaagataatgttgattctcctcagaagccacccccaacaaccttgtttgcttctagacctataactagactaaagtcctgccagggacctctggccagcccctagaggtgaggttgagagtgtgacccataaggaggtgcgctacactcaaaaataactgtttgagttctctaatttatataaacagaaatctggagaacaggcatgggaatggatattaagggtgtgggataatggtggaaagaacatagagttggatcaggctgaatttattgatttgggcccatgaagtagggactctgcttttaatgttgcagcttggagagttaaaaaaaaaaaaggttataatagattatttgcttggttagctgaattatggattaaaagatggcccactgtgagccagctggaaatgcctgatctcctttgggttaatatagaggaagggatccaaaggcttagggagattgggatggtgaactggattagtcactttagactgactcatcccagctgggagggtccagaagatatacccttgatgaatgccttgtaaaatagatttgtgaggggagcacctgcatctttgaagagccgtgtaattgctcttctctgtatgtcagacctaacagtggcaactgcagtcactcacctacaaaatttaaatacaatgggaataattggatcctgaggtggcaggagccaagtggtggcactcaaccatcaaaagcaaggtggacgtagctaccataatggacagtagaggcaaagcagcaatcagaatagtctgactcatgtagagctctggcattggctaattaatcacgatgttcctagaagtgaaattgataggaagcctactgcattcctacttaatttatacaagcagaaaacttctaggtcaaatggacaaaagactaatttgaattataaaaacagagaatcatggcttttcaattaatttccagacttgagccagtttgcagacccagaaccccttgaatgaagtggagtctgggtccccttgaggaaggaccccactacagtaccaacaatttatgcagtgaatctttctcccatccttccccaaggagacctctggccttttaccagggtaacttgcactggggaaagggaaatgacatttcagggactactggacactgcctctgagctgatactgattccaggagacccaaaacatcattgcggtcctccaggtaaagtatggacttagggagttcaggtaattaatggagttttagctcaggacttacagcgggttcagtgggtccccggactcatcctgtggtcatttccccagtgccagaatgcataattggcatagacatacttagcagctggcagaacccccacattagctccctgactggtagggtgaaggctgttatggtgggaaaggccaaatggaagccactagagctgcctctacctagaaaaatattaaatcataaataatatcgcatccctggagggactgcagagattagtgccaccatcaaggacttaaaagatgtagggatagggctggctgggcatggtggttcatgcctgtaatcccagcactttgggaggccgaggcgggcagatcacgaggtcaagagatcgagaccatcctgggcaacatggtgaaaccccgtctctactaaaaatacaaaaaaaaattagctggacatggtggtgcatgcctgtagtcccagctactcaggaggctgaggcaggagaactgcttgaacctgggaggcagaggttgcagtgagccgagatcatgccactgcactccagcctggcgacagagtgagactctgtctcaaaaaaaaaaaaaaaaaaaaaaaaaaaaaaaaaaaaaagaaagatgcaggggtggtgagtcccatcacattcccattcaacttccccatttggcctgtgcagaagaccgatggatcttggagcataacagtggattattgtaagcttaaccaagtggtgactccaattgcagctgctgtaccagatatggtttcattgcttgagcaaattaacacatctcctggtacctggtatgcagccactgacttggcaaatgtctttttctccattcctgtccataaggcccaccagaagcaatctgccgtcagctggcaaggttaccaatatacctttactgtcctacctcaggggtatatcaactctgcggctttgtgtcatagtcttattcggaaagaccttgattgctttttgctttggcaagatatcacactggtacattatattgatgacgttatgctgactggacctagcgagcaagaagtagcaaacacactggacttattggtgagacatttgcatgcaagaggatgggaaataaatccaactaaaattcagggaccttctacctcagtaaaatttcctgggttccggtggtatggggcctgtcgagatattccttctaaggtgaagcaagatattccttctaaggtgaaggaagatattccttctaaggtgaaggggcctttggcccctcctacaaccaagaaagagacacaatgcctggtgtcacaaggcctatttggattttcgaggcaacacattcttcatttgggtgtgttactccagcccatttatcgagtgacctgaaaggcggctgattttgagcagggtccagaacaggagaaggctctgccacaggtccaagctgctgtgcaagctgctctgccacttgggccatatgacctagcagatccaatggtgcttgaggtgtcagtggcagatagggatgccgtttggagcctttggcaggcccccatagatgaatcacagtggaggcctctaggattttggagcaaggccctgccatcttctgcagataactgctttcctcttgagacagctcttggcctgttactgggctttggtggaaactgaacatttgactatgggtcatcaagtcaccatgcaacctgaactgcctatcatgaactgagtgctttctgacccatctagccataaggtaggttgtgcacagcagccttccatcatcaaatggaagtggtctatatgtgatcaggctcaagcaggttctgaaggcacaaataagttacatgaggaggtggctcaaatgcccatggtctccactcctgccaccttgccttctctcccccagcctgcaccgatggcctcctggggagtttcctgtgatcagttgacagactaagagaagactagggcctggttcactgatggttctacacgatatgcaggcatcacccaaaagtggacagctacagcactacagcccctttccaggacatccctgaaggacagcagtgaagggaaatcttcccagtgggcagaacttcaagcagtgcacctggtggtacactttgcatagaaggagaaatggccagatgtgtgattatacactgattcatgggttgtagccaatggtttggctggatggtcagggacttggaagaagcacccaatgcttctgccaggactaccatccatggactcatggaatgccttatccgccatcatgttattccacacggcattgcctttgaccaaggcactcactttatggctaaagaagtgtggcagtgggctcatactcatggaattcactggtcttaccatattctccatcatcctgaagcagctgaattgatagaatggtagaatggccttttgaagtcacaattacaaaatcaactaggtgacaatactttgcagggctggggcaaagttctccagaaggccgtgtatactctgaatcagtgtccaatatatggtactcttccccccatagccaggattcatgggtccaggaatcaaggggtggaagtggaagtggtaccactcaccatcacccctagcaatccactagcaaaattattgcttcctgttcttgtgacattacgttctgctggcctagaggtcttagttccagagggaggaatgctgccacaaggagacacaacaatgatcctgttaaactggaagttaagattgccacctggacactttgtgctcctcctacctttaagtcaactggctaagaatggagtcacagtgttggctgggtgattgacccggactctcaagacaaaatcagtctactccacaatggaggtaagtaagagtatgcatggaatgcaggagatccatgagggcgtgtcttagtattaccatgccctctgattaaggtcaatgggaaattacaatagcccaacccagccaggactacaaatggcccagacccttcaggaatgaaagtttggatcactccatcaggaaaaaaaaccacgacctgccgaggtgcttgctgaaggcaaagggaatatagaatgggtagtagaagaaggtagtcatcaataccagctatgaccacgtgaccagctgcagaaacggggactgtaattgtcatgagtattttctccttttgttaaaaacatgtttgtgcatgtatacatttgtactaagaaatgtcttcattttatttcctttttcctttatcatgtgacataagatttattgacttcatatcagcatttaagtattaactttatattatagtatttgggttggggattggtgcatttctggttgtacaaaggatagttgtattatgttaggtgtaattatgaccttattattgtctttatttgaagattatgtataatctcaggaaatgtatatgggttcaaattgacaaggggtggttgaaatggttaatactgagtgtcaacttgattggattgaaggatacaaagtattgatcctgggtgtgtctgtgagggtgttgccaaaggagattaacatttgagtcagtgggctggggaaggcagatccacccttaatctggtgggcacactctaatcagctgccagcgaatataaagcagacagaaaaacatgaaaaggagagactggcctagcctcccagcctacatctttctcctgtgctgggtgattcctgcccttgaacatcacactccaagttcttcattgttgagacttggactggctctccttgcacctcaagcttgtagacagcctattgtgggaccttgtgatcatgtaagttaatactgaataaactcccctttatatacatatatatatatatattcctactatatatataatcctactaatatatatattatatatcctattaattctgtccctctagagagaaccctgactaatatatcattagagtgagaccctgtctcaaaaaaaaaaaaagaagaagaaaagagagtcctttgattttgctctattttttcaggatctttttggctattctgaactccttacaatattgtatgaatttaaggattgtcttttccatttctgcaaaaagttttgataggattgtgttgcatctgtagattgctttgagtagtattaacattttaaccttaataacaataagtcttcctatgattacaggatatatttccatttattcaagtcttttaaaaaatttcttaaagcaatacttttatctccttggttaaatttattcctaggtattttattcttttggatgctattataaatataattgtttccttgatttcctttttgctctgttcattgctagtgtatagaaacactgattttggcttgttgatcttataccctacaacttagctaaatttgtttattgctctagttttttttggtgggggtggtgaagggggtggattctttttttttaatataaataggatcatataattatgaatagagatacttttactttctttccaatttggatgccttttatttcattttagtgcctaattgatcagtctacaacttttagtacagtgttgaatagccgtggtgaaaatgggcatccttgtcttgttgctgatgtttaagggaaagctttcattacttttatctttgaatatgatgttggctctgggtttttcataaatatactttattatgttgaggaatttcacttctattcctagttttctgagttttttttttttttaaatcatgaaagcatgttggattttgtcatgccttttcagcatcaattgtgggatcatgtatgcaattctttactttttctgttaatgaggtgtgttggcattgattgattttctaatgctgaactacctttgtattcctgggataaatcccacttggccatggtgtataatccattcagtatgctgttgaatctgttcgctagtattttgctgaggatttttggtctatcaactactcacactaccctacttgaggctacactgttggccattcattcctttgatagttgttattgttgactcctttcttcccaaactactcttggtgtttctgaggcagtatgcgctcctgtttttttctctcatttctaggcatttctgtgcctacactgtagatttttcctctcttcatcctttaagtgttagtatatctcagggatccttatgagcctttgagtgatcccatccacatccaaacttttatttttattttttgtagagatggagtcttgctatgttgcccaggcttgcttcaaactagtggcctcaagcaatcctcctgcctcagcctgccagagtgctaggattataggggtgagccaccttgccagttccacacccaaacttttttttttttttgagatggagttttgccctgtcgcccagggtggagtgcaatggtgtgatcttggctcactgcaacctccacctcccggggtccaaatgattctcctgcctcagccttttgagtagctgggattacaggcacctgataccatgcccagctaatttttgtatttttagtagagacagggttcaccatgttggccagggtggtctcgaactcctgaccttgtgatctgcctgcctcagcttcctaaagtgctgggattacaggcatgagccaccgtgcccggccccaaacttttatatattagtaactcccaagtcactgtctctggataaggccacttctctgatctacatgtagagccaccctctgaacagctccattgcattgtcccacgggtatcccaacacccaacagaactcacaagtctttcatgtttgggcctctgtttacctgtccagagactatcaaagttgttcagagccatttcaatcttaaggtaagaatgctttgcattcagttcaaatctgggttatggctgggcacagtggctcatgcctgcaatcccaggactttggaaggccaaggagagaggactgcttgagaccaggactttgagaccatcctggacaacatagcaaggcctcatctgtataaaaaattttaaacattagccaggcatggtggctggctctcacctgtagtcccagctgctctggaagctaaggggaggattgcctgccccagaggttgaggctgcagtgagctatgatggcaccattgcactccaccctgggcaatagagcaagaccctgtgtcaaaataaatacaaacaaataataaaaataaaaacaagtccgagttatgctggcttctagctctgtgtactagagcgcattccttagcttcttgtttctctgttgcctcatttgtaaagtgggaatgataatacttggtattaggattaatgtgatccatatcaagttctaaatgaactgcagctctttagtgatagcattggtcagacccgaggggatactgtgcaaaggggtggaaagtaataccaagctgaccattgtttctgccgaccctgacttttgtgctttcacccagtttctggtggagaacctgattgacagaaaccagattaaaactggagccttactctaataaccctactgggtttaatctgcagatttatctttatagcaaaatctttttattgttttaataattaagatccctttggctggtgatccaaattggatgttattctgctgtatagaaaacagtatttattaatgtgtttttatacttgatgcttgtcttaaggtgatcatccactgattttcacttaaataattgtgcttttctattccctctgtctctgtgcttaaaatcttggctttaccattcatgaaaaagaatggaaaatatatccattaagaatcagataagaattcgttaaaagagaaagcttggaaatctctatatttaagtactttttaacggtgctgtgaaatgattaattgctttgttttaaatattgctaagacaccataaattaaatatttacacatcctttttatatttaaaaatagattcaacaattattaaagctattaatacctgaactcctaatcaaaatcaaagaaatttttagtttgaataaggcaatgggatggaaaatttgctgtgtttttaaggctccctttaagtttaaaaactaggtgcctaatttgtgacttttttgctaaattcacttttaaaatgacttaaaaatcacttacgctttatttttctttcaaatctttttctcctaatcttttaaaataaggaaaggtgcctccgtgttgggtattataattgtattcaagtttttgcaactccattcaaaaaagtacgtattttgtaagctcacctggacaggtggacttgatgaaggggatggctctgagatgccggttttcagccacaggcccttcagcgcttaaacagttagagacagggtacgtttctggccgaaacccgggagccgagtcctcaggaagccgcagggggcctcgagggagcggactgggccgactggctctagaggtccggcagcacaggctccgcccgcaggggcggtgcccgagccggcttccctagagcccgccctccgcgtcctgcacccccgcggcctccgcggcctccgcggcaactgctcccggtgatgcaaaccctcacttcccgcatccacttcctcacagagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggtaggtgcgccgcgccccgccgcttcctgggcccctcgcgctgcggttcacccgacctccggggcccccgtgggagaggcgctgccgcctcctgaatgacaggcgccggcatcgctgcattcctcccaggtgactaagagcgccgtgccacctgacctcagtgagcagcacctgggaatgccggcatgttcccggccaggcacgtttgcctccgtccccgccgggttttcccttggtggctgttgcgggtagcagctccgtggagttctgcatgatcagtctgcaggactgcagtgccaccccaccggagacctcggccgtcttgtaattctggtgaactgtgatcttgctaatggattttaactgtatttaattaaatgtgatttttaggaagtgaaattgcagatgatctaagtatcttatattcaaatagagcagcatgttacctaaaagaaggaaactgcagtggctgcattcaagattgtaacaggtaaactgcacgttttcaggtttgtcaagagattgttataatttcattatggtgaatgcaatatccaagatcctaaattttctgcctaaggatctaatttcttaagagctttatggtatgttaattgattgatgcataaaaatcataaattatcttacgtatatgaagagagttatagaagattgtgcaaacttttttcatttccactgctaccgccctaattcgtgctcttttcatatcactcctagactactggagaagcctgataactaattccaatccactgcggcatcagaataactttcctgaaacattattttgttcagattgtttccaacaggcctttaatggctcagtattggcttcgaaataactgtaaacttctctgtcactacactgcctccaagcaagtttctccttccgtttggtctactggaccacttgcttactctcgcccaccttgttctctgagcccttgcccatgttgcccctaatggtggtaatgccctttgcacatcttatcttctgaagttcttgctcagctgccccttctctctaccttcttgagtgccctagacttcctggtcatctgcaggcctgtaacacctacactgacactcggtcacacctctaagtcctgttatccactgaagggggtttaaacacatcgaggttaggaaccatgtcttttcttttttaatagacaaataatcactgtacatatttatggggtaccgagtgatgcttcgatatatatgatgtggccaggcacagtggctcatggccaggcacagtggctcacgcctgtaatcccagcattttggcaggccaaggtgggtggattgcttgaggtcagtttgagaccgtcctggccaacatgatgaaagctagtctctactaaaaatacaaaaattagctgggcctggtggcatacccttgtagtctcagctactcgggaggctgaagcaggaaaattgcttgaacctgggaggcagatgttgcagtgagcagagatgccaccactgcagtccagcctgggcaacagacaagagactctgtaaactttactcatatatatatatatatatatatatatatatatatatatatatatatatatatatatatatatgaaactatgtatcattgttaactatagtcatcctacagtgctatagaacactagaacatgtgcctcctatctagctgtaattttatatcctttaacaaatctctgcctgtccccctcttccccctaccctttccatcctctggtgtcctctgaggaaccctgtcttatacagcttcgtacccctcgaagcataatagtcacccgtggtactcaataagttacctgcctggatggtaaatagctacataaataaaacattgttttccaccatgaagtaataagaagccctttggcaagaagctactattagtacatctaaaaaagaagaagtcatgtcctagtttgactaacacagctctggcttactcctgttgtctcatataacactctcagaaactctagtttgaacagtaaattatgtggacactgtttataaggtgagtaatgtattattgttttcattggctgtatcagtttattttgtttttttgttttgttttgtttttgagacagagtctcgctctgttgcccaggcgccatctcggctcactgcaagctccgcctcctgggttcaccccattctcctgcctcagcctggagagtagctgggactgcaggcgcccgccaccatgcccggctaattttttgtatttttagtagagacggggtttcacagtgttagccagaatggccttgatctcctgacctcgtgatccacccgcctcggcctcccaaagtgctgggattacaggcgtgagccaccgcgcccggcccagtttattgatatgggtaaagcttgctagtatctgtgcctaagtttaaaaagaaggccttgaggcacttgaatttttttgccagttttacatatttaaatttgaagtgaataatacttatattctctttggcctgacatcagaccgcatcctcagttgtgctggctcacactcgctaatcattacatttttcaggattttgtgagctggttgatgtcaagttgatattttgaaatctgccatggtgggataccatttaataccatgaaatgagcaaatgccacaaatctgggcttcccacccctccttttttctttacccagagagccagttgttaagggcttttaccagtgctcctaacagaccagaccatgtgaatttgttggataccaagcccgtggtgatttgcagccaacatcctttcagctcaactgtctgtttctaatccattacccttcagacttgttttaggcctttccacagtgagggaggtcaggacactttagttaaaacttgagacccctaacattagagctgctgcaaaagagtggatttgtgttgtccttatctgagatcctctaaggtgattaacatttactggctaaaattggctgtgtttcagtgtagacagaggagaaagtcaagtatgggactccagccatggtgtccagggtggctagagtaggggcttgtccaaggggagggcaggagatggctcaccagagagggaagtgggcgtcggtttaggtaggttgtgctaaccttaagagctgttttctaggcaaggaacctggccttgctggttggtgctgacctccgtagagaccgacctactcagatgttttctttgatagctggcctaccagtcccagtgtaagagaaatggagatgaggcccagcagggggtgattttacactaaagcagtgattctcaatcttgttttaatgccagagaagccactctgtgcttttgtgaacatcttttcagctcaagtgactatattcaaacagattgcatacatgttaaagggagtttttgtgttttcattttgttttgttttagtttttcagttaattatctttgctctttggagagttccatgagttctttttttttttttttttttttttgagactgagtcttgctctgtccccgaggctggagtgcagtggcgcaatctcagctcattgcaacctctgcctcccaggttcaagtgattctcctgcctcagcctcccgagttgctgggattacaggcactcaccaccgcacctggctaatttttcatattttttgtagagaaggggtttcaccatgctgcaggccaggctggtcttgaattcctgacctcaagtgatccacctggtttggcctcccaaagtgctgggattacagggatgagccactgtgcctggcccaaaagttcttatcaccagataagtggtatcaggagtcaaacactgagaaagaaaaacaggcaaaatttaaaataagaggagaaaattttacctatgaaaataatttttaaatgtattttgggaaaaactaccatttgattttaaatgtcttacctctgaggagcattggttgttttccaggggtgtgtttggagagtggccatttggagtgcagagttggggttgggggggtgttgaagatcttgaaggtctctaagcctggcctctcccctcaccacagcatctccatgactcttttagacctccaggtgaaacatgaaaaggggttatgatgcttcagtttgaaagccatcattttacaacttttaaaatactcataattgtttataagctaaaatacttcacttttctcatctatcagaacctttttggtttatctaaaccacaccaaaaatcttttggtgactttccattgaggacatttcaacagactaaatacaaatgaatgttgcctagtaattctctcctttttcgtttttcttttcttttctttttttttgagacagagtctcactctatcacccaggttggagtgcaatggcatgatctctgctcactgcagcctctgcctcctgggttcaagcgattcttgtacctcagcctcccaagtagctgggattacaggtgtgcaccacctaacccagctaatttttgtattttttttttagtagaaacagggttttgccatgttggccaggctagtcttgaactcctggcctcaagtggtctgccaaccttggcctcccaaagttctgggattacatacaggcttgagccaccgtgcctggccagttctctgctttttcttatctttgctactctcacagtcttgaaattggaagattttttagggtcttaactgtgttaccttgaatagatagcctcttttgtaagctctgcttcaaaagttctctgtgcttatttttatacatgggtggtttttttccttaatggaatttccattcataagttcatattcattttcaggattgtagttaaagaaataaatttactgggcagaaagtgctaaaaattaatacagcatctcatcagttttagatcccaagcttggcttaaggccatcttgaatagataaatggcaccttggtcattggaagtcttctgtgaagtgaaggtagtcacatggttgtgactctgctcatagagttaatattacctaaacattaaactaagctaaatttaaggcagtggtacaggtgacagatcctgatgcccacagatctattttctagtgttgaaatatgtttacttgattttaattttatattttaaataacatttactgttttaaaaaaccacttacctattatagaaaacttaagaaaaaactagcacagcacaaagactatcattaaaatcactcacaatcctaacacctaggcagagtgaaattggttattttttcagagaagtgaagcagattaggtttaacagcatttctagagtaacttctatgatatgccagaagggctcccacaagtgcagctgagtatctgtatgatgtggtctgagtggcaaatgactcaagagttccttcatttgcagtgtttgtatgtgtactgcggtaggcagagtgtaggcttttgagggctcacagagaagtttgctgagtgcctctcatgacccaggtgatctaggactgggaatatagtggtgctcaggacaggcaatgccaattgccttcctgaagctcacattagaaagaactgacctgtgggcatgtcactcctcatgtttctgtttcttcacccacataatgaacatattaatatttacctgacaggtttgttgtgagattagatggggaagtctacagtgactagcacatagcagatactctgtcaatgtttcctcattgctgaatcattgtagacaggaatagacagcagatttctaagagtatcggaaaaacagcaagttaaagaaagcagcccttgctcatgctttcctggaaagttaaatacttgttatattaactgtttatagcatgagttgaaagaataaatccaccatcttcaatgtggacagtctggtgcagatgttagttaggttatatagaaaggaggctcttcataggatctctgcatggaggacttctttgcagcttctgttgattttgttaaaaccaagagtactatagttttcattcataaatacagatttgtgattccttaaccaaaggctctgcgctgccttttgacttaacatattttcagtttaccatgggattattgggacataaccatattgtaaatcgaggattatatgtacagtttttttattgttttacttcagaatataatgaagtacgttaaatgctgaagtagctttaaacacttcaaacaaaaccaaaaaacacaaccatgagatacatctttagtgatattggaaacacttcatagactaaaacgtgcaagatgaaaattcataacttagaagaaatcattgtaggtttagttccttgattcccctttggtctgtttttgaagcccttttgcagcaagtgaatcataatgaactaataagttttagagtgccgattttcaaaatgtgatgcaacttttatggttctgtactttattattaaatacataggtgcaaataagaattttcattttaatctgtcaacgacaatctgttgaaaccctgctgtgtgccttgtgccatgctgctctgttaggggactggggaggccaggacatgctgccagggagctcccggctcagtgggaaagagtaaatgcagagtgctttgctactggtttaaaagaaaggaacacaaatatgattgctttcttactctgggtttgcctttctggcatgttgcctggttcccaagacgaagtctcggatgtgtacatatttgagagttcagtactgcagtatctattcagtgaagtataaacgaaagagcatttttcaaaacaaatggtatgtaatatttttgtcttctttagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggtaattaatctgaggcagctacctaaaatctagttgttttatactgtttttcccttcccctccttcaagaacatgtcaaaatatagatgtgttatcagttacttttatcacctgaatgattgccttcttttattccattacatcaaatggttctctcccttaacttaatttctgactctcccttaattaattctgacttgtcctctaatgcctttgtatttgttttctgatccatttattactgttcaatcagtatttttttttggtcttagtaacacaggatataactcatatgtgctgcttaaatatatgtggtgataagagggtatttacatagatatcataaaatcagtactagtagctgggtgcggtggctgatgcctgtaatcctagcactttgggaggccaaggcgggtggatcacttgaggtcaggagttcgagaccagcctggccaacatggcgaaaccccatctcaactaaaaatacaaaaattagccaggtgtggtggcgggcgcctgtaatcccagctactcaggaggctgaggcaggagaattgtttgaacccaggctgcggagattgcggtgagctgagatcataccactgcactccagcctggacaacggagcaagattccaactccaaaaaaaaaaattaaaataaaataaataaatcagtactagctatagaataagatccaaaaatgtggtgaaaactgctatgttgaatcctctcctcccacaggatttgcaggtgttcattggcaccatatctgtcagtggaaacatatctcttgtttctcctgaggagaatggatgtcttcatgagcctgccagatatttctgttatatgcccttgtaaatagacacttatctaggatgaatagtaatttataatggcgaaatagcaaagaatttggatctaatttatgttatgacctatttacccccagcgtgagaatgggaaggtaaaaacttccagacttcatcaattgctttccggtgaaatttgaaaattaactagttggataacatttctagttatgtatgacattttctgatcccatttgcttaaagtgtaacttctgaaatatttatatgttacactgtaccccatgctagtctagtggaccaggccttgatcctctcaaaaaagaaaaaaaggggaaaaaatgacatggtctccgtctttaaacatactagaatatagttgggtagaaacagtgtacagcagtttatctccaggctcggggaaggggatcacagagaggccaggccacctgtgtctgtatgggctgaacttgttgcagagagagcacttgaagggggctttgaaggatgctgagagaacatgaagagaccttaaacaaaattgtagaaaatgagaatggtaattcaaggtaagttttaaaatcagaccttaccttcccatgtggtcccagccctgctggaaagatacataggcagaagtgacaaccgttctcttggtagtcacagggaacctgtctgatcccagcctgcctagaagaaagggacatacatccataatctgtgatggggtgagatgagacgtcttgaacctctggcacccacagcctccttgaccttgagcttccttggccttgaccaggcggtctcacctggcgctgcacagccaccccacggtgcgccatctgctgcctccttttatgtgcctgcaggccctttctcctttttgtctttgaattccttctcatctatcaggagaggacttgcctcctctaggaaactacttgccctgatccactgtctccctaccccataggtgcaccttaggttccctttctcagtgcccccataacactgggccctcttttattacccagcttctatattgttttcacgtttgctgtctccctgtgtaaaattcttttcctgtagctgtagccggtgttccctgaggtcagaaattgtgttttttcatctttgtcgctgcactgcctcctgtgtctgcctccagtagacgtcctcaataaaaatgagtgcattttcaaacagagaacacagagttcactcctgtgctttggggcattgtttgttgcttttaattcgccccatcctcggcttagtagttttcaaggtagagctggagaaagtaagatcttctcacagtgttagaggttatcatgaaatggaaagtggggagacaccggaagtatctggcagagaggagggcctgatgaaaaggtattttaggaagtctaattaatagtaggctgaatggttgaagggagaaatgggtctgagagaacatgattactgacatttctgaccttttgcattatagtttttctaaaaaattgaggtagaattcatgtacataaaattaactaagatgtgcaatgcagtggcattttgtacacttaccatcttgggcagtcatcacttctttctagttccaaaacatttccaccaccccaaaaggaagccctgtacccagtaagcagccactccccattttcctttccccccagcccctggcaaccacaatctgtgttctgtctctacgggtttatctgttctgatgttttatctaaatggaatcatatatggccttttgtgttgggcttctttcacttagcataatgtcttcagggttcatccacggcatagcatggatcagtacttcattgctttttatggctaacattccattatatgcatgtatatatcatatcacatcttgtttatccattcaccagttgatgaacatttgggtcattttcaccttttggctattgtgaacagtgctgctgtgaccattcatggacaaatttttgtttgcatacttgctttcagttccttttcgtatatgcctaggagtagaattgctgggtaattctatgtttaactttttgaagattgtattatatttgttatatgtactcaggaaggttcatttaaagtaattgacttttaagactgagtcattttttttaattgaatggttcttgttgatattttgttgatgaggaggctttggttttgccatatatatttttatatacaatatctgtttaaaatttttcactatttcttatttgtgaatcccacatttatgcttgcttttccatctattccaattcattatggaaaattaaacagcagaagcttttttttttttttaaatttaaacatctgtatttattttgtttctgtcttccattaaccatatgcctctcttcctctccaggaatcttatatgttaaatttccctgcatatacttatttattccctggcaacacatcatctcttttcagctgcttcttccttcctctctgctggtaatataagttttgcttgaaaattcttttttctgaaacttctttttcttctgcaattctgggtggttatacattaatttaaatttttttttacattaaagcataagattcaattattataaccaaagatcactatggaaatttaagtttaagaaactgtagggaaattatgtgcattacatttgtctatatataaatataaaagtttttcacacaaaaagttgcgactagatttaactaacttgaatttattctgctaattgccagtaaaccaattcagtcttaggaagcagttctttttaaccagatttgttcaaaagacgtaatttttaattttatttttaaatctaattatgacattctgtatgtttaaaataatgaaaaagtgatcactgaggatattaatctaaattttatgatggccatcagtaaatgccattaataaaaaagcccttgtagtagaatctagtatcttgtattttcatctttattcatatgaaaagagaataaatggggctgggtgcggtggctcacgcctgtaatctcagcactttggtaggctgagatcacctgaggtcaggagtttgagaccagaccggccaacatggcaaaaccccgtctctactaaaaatactaaaattagctgggcgtggtggcgcgtgcctgtaatcccagctacttggggggctgaggtaggagaactgcctgaacccgggaggcagaggttgcagtgaaccgaggtcgcatcactgcactccagcctgggcgacagagtgagactccatctcaaaaacaaaacaaacaaacacacaaaagaataaactgataattatagagatgaaaaaaatacagagcaagaaagagtatcttaaacacatgtaagtgttttgagaaaaagcattattcacatgacagcgagcccttaccagtgttggcagccagtcttgtacacctgttgtcaaccacagtagttggtaatgtggttatcataatgtacagtttgggcacagaaattctaaaatacttctgatcattctcaagagtaatacattatcaatttagtaatgattttaaatattacaggagacatttcttctaggcctcctaaattttagttttattaatatatttaactttctcaaaaaatacaattttattatgtatatgttaaaattttttaacaaattaaaaatgtcttttttgttttgattaaaaaatagtctaagttgcatcatttatgacaacttgtaaatatctttttgaaaacagtttatacggacagaaaatgctcaggattgcatgttttctacaaggaagtacacatttgcatagcatttgcaaattttattcttaatctgaccttcagtaatataaaaagcaaactaaatgatcaacagagaaaattcactttctctttaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacaggtgggggatgcctgcactcatttcttctcaaggttaccttgagttgtgtgtgtactttcacagtaaagcagagagataagagcattaattctagaatcagacctaggtttaagtgaagtccctgttctccctattttattattattttgagacagggtcttgctctgttgcccaggctggagtgcagtggtgcgatcttggctctgcttcctgggttcaagcaattctcctgcctcagcctcctgagtagctgggattacaggcatgtaccaccacacctggctaattttagtgggtttttttttgtttgtctttagtagagacagggtttcaccatgttggccaggctggtctcaaactcctgacctcaaatgatctgcctgctttggcctcccaaagtgctggaattatgttctccctctttaaaactacatggtcttaagaagttgctacatacctcctgtgtcctactagtatacatgtaaaagcgttttttgttttgttttgttttgagacaggggcttgctctgtcacccagggtggagtccagtggcgcaatcacggttcactgcagtctcgacctcctaagctcaagcaatactcctgcctcagcctactgagtagctggaaccacaggtgcacaccaccatgccagctagttttttttttttttttttggtggagtctcactttgatgtccaggctagagtgcagtggtgtgacctcggctcactgcaacctccacctcccaggttcaagcgattctcctgcctcagcctcccgagtagctgagattacaggtgcctgccaccacgcacggctaatttttgtatttttagtagagacggagtctccctatgttgcccatgctggtctcaaattccagggctaaagtgattctcctggctcagcctcccaaagtgctgggattataggcatgagccaccatgcgtggtttaaggcaggggaatgtattaataaatgtctcacaaggaggttgtcagaaataaatggagatgtgtatataaaatagtatattctgactttgtaaacctgtagtaacctcttaaacattgttaactaagaaggccaggtgcagtgggtcactcctgtaatcccagcactttgggaggcaagtggatcacttgagcccaggagttcaagaccagccggggcaatatggcgaaaccctatctctacaaaaaaatagaagaattagccaagcgtggtggtgcatgcctatagtcccagctacttgggaggctgaggtgggaggatcccgagcccaggaaggttgaggctgcagtgagctgtgatggtgtcactgcactccagcctgggtgacagaataagatgctgtctcaaaaaaaaaaaatttaaataacatgtagctctacagtagaccctgtatgtgatgaggctaaaggaataagactgatatgtttaaaataataaagtaaagccccacaacataaatataatcatgtgctcataatggtatttcaatcaacaatggagcacatatatgacagtgatcccataagattatatactgtaactttactgtgtttttactgtaaaggtactatactcttactgtaccttttctgtgtttagatacacaaataccattgtgttacagttgcccacagtattcagtacagtaacatgctgttacaggtttgtagcctaggagcattagcttacaccatacagcctggatatatggtaggctataccatctaggtttgtgtaaccacactctatgatgtttgcacaatagcgaaattgcccaacgacaaatttcgcagaatgtatccattgttgagtgatgcatggctgtgtaatgcaggtgcttccttctgtctttattgtagttgttaaaaaatttgtattcccttagtgcctacattattactttgagtgtagtaagtaagcatttaataaatgtgacttcacccttgctttctgctttaaagccagctgaggccccatttctcccacaaagcttagaaactccatatgtgtccccaggctgtgcttcatcttgcagatgccctgaggttcctgacccatgatgtccagatggctagtgttggaccctcattttctttattgccaagaaagagcagacagggaatatctgccaagtagatgatctagcagtcctagggaaattatggagatctgtagttttctagagtccattattaatagggcctgacacaaagcatttgttcagtaaataagagctacttcttattaacaaaatgcatatatagctgtgagttagcaaaccatagcacaagtataatcagctgtgtttgaatttttctgtccatatttgtttactgattgatagtgagaatggataccaaaggtttaaagacactggaggataaaagcttgaggaaaatttttcagcaaaatcttccctaatattctatttcagggtttatataccaggattgggaaagtaccatttgaccctattgtgtcagatttttttttttttttttttttttgagacaggatcttgctctgttgcgcaggctggggtgcagtggtgcaattttggctcactgctgcctcgacctcctgggttcaggcagtcttcccacctcagtcctgagtagctgggactacaggtgtgtgccaccgtgtctggctaattttgtattttttatagagacaggatctcattatgttgcccaggctggtctcgaattcctgggctcaagtaatccttctgcctcaacctctgaaagttctgggctaacaggtgtgagtagcctaggctatgtgagatcttttgaaacatgaaacatgggcagaaatattctgtgatttgaaatagaagatgaaaagtaaactagcattttatacaatttgtgcagagggacaaataagattattgtttacattctgagtttatattataaatttagggggctgggcatggtggctcttggcagtaatcccagtagtttgggaggccatggcaggaggatcacttgaggccaagagtccaagaccagcctgtgaaacaaagcaagacccccatctctaccaaaaaaaaaaaaaaaaaattggctgggtgcggtggctcacacctgtaatcccagcacttttggaggctgaggtgggcagatcgccagagctcaggagtttgagaccagactaggcaacatggcaaaaccctgtctctactaaaaatacaaaaattagctgagcatggtagcatgcccctgtagtcccagctgcttgggaggctgaggtgaaaggatggcttgagtccagaaggcagaggttgtggtgagccgagattgcaccactgcactctagcctgggcgacagagccagaccccatctcaaaaaagaataataataataaaataataaatttatctatcagaagattttaagattacaaaatttaaaggtatattttaaattttaatttatggatttttattatatatcaaattattccataggataaacttattacctaggtttaaaactttaaattttaatattttgtgtatgtttgaaaacttggttgtaagtaacagaaaatctgttgacttaaagtgtaagggatggtcttggcttgtgtcactgaaagggcccagacaggctgtaaatcaggctcaactcattaagacttaggctgtagcaggaaacaatagaactgtagcagttttaggctttacatctgcacatatcagtgtccaaagagagagagaaaccattgattttgatggcattaagaatgaggaagtaggccgggcgtggtggctcacgcctgtaatcacagcactttgggaggccgaggcagcactttgggatcctcgaggatcacgaggtcaggagatggagaccatcctggctaacacagtgaaaccccatctctactaaaatacaaaaattagccgggcgtggtggtgggtgcctatagtcccagctacatgggaggctgaggcaggagaatggcgtgaacccggcaggtggagcttgcagtgagctgagattgcgccacccaccgcactccagcccgggcgacagagcgagactccgtctcaaaaaacaaaacaaaacaaaacaaaaaaaaacaaaagaatgaggaagtacatttccccaaggcccaggctttttaatctgttattctgttcatctgaattgggccatgtgcccatccctgagccagtctcttttatgaggaaacaccccacgcactgaatggcttagacctggggttttgatcagtgaggtcagcctcccctgaacacgtggtctgaataggagaggggtgatagctgaatgaatattgaggtcctggaaacagattctgagcagggtatcagccatgttcactgcaagataatagggatagtgtgtaattctggtaatgagcagttcagactctgattgtagataacagaaagcccaacttataatgcctcaagtaagcaaaaagctgtttatgggcacttactatagacatatccacaggtggagtggctgcagggatggctggattcaggactcagagactccagctctccatcttggcctcttccttgctctgatggccccattttcacatcatccctttttatcacaagatggaaaaatagctcctcctttgagccttaaatcccacaggaaagaaaaagatttattttacaagaaccttgcaaaacattttatcagctcttatagactcatccctgaacaattggattactatggccataggaccatgatgtgctgattaataaaatgattatcccaaaggttagggctggagtgaggtttgcttcacttaaaccaaaggagcacagaatgaaagagatatgatttcccaaggaaatttggggtgccggatagatgtccacttcaggctttaagaggagtgttcactattcacaaaataattgccaagcaaaacactgtggatatttgtatcccatttcattgactggttctgtcgtatccaagcttaaccagaggtctgaagtgctcgtgtaccactgtaaaagcgctgtgtgaggcagcatagatggagatgacagaaaacactgtgagggttgctagttcacatgtgcagccttattggagactctgcctcttgtcatatagtcacctgagccctgttagcattgtttgcttaattctctccatctctaaggtggttctggcctctgttactgtctttagaatcccagtagagaaaagatggcatgtcaagatggataacatgacagaattattacttgtatcttattttatttttttgagatggggtttcgctcttgttgcccaggctagagtgcaacggcatgatcttggctcaccacaacctctgcctcccaggttcaagcacttctcctgcctcagcctcccgagtagctaggattacaggcatgtgccactacgcccagctaattttatatttttagttaagatggagtttccatgttggtcaaggtggtcttgaactcctgacctcaggtgatccgcccgcctcggcctcccaaagtgctgagattacaggtgtgagccactgcacccggcacttgtatcttattttctaattagaaaataatagtatcataattatataattatttttacttatagcctatttgtcattttaatttgtctacaaagttttgttctagttagattttcaccctgcatgctgtgtggtcaagttaatttgcaatagaagatttacttatagttgtacttaagattttatagaggtgcttgtacagatacttcctcttctttgtttttttgtcccatagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacaggcaagttctttgtaactttatatatttcttatgttaatagttttgattattaaaaatattttaagttattttattaacacaattaagtaattgccaaagttttttgtgatggttctaagaatttctatagcaagctgtcctaaccaagtgtgtctgaaagaggtgaggccgtgggagttctacagagactggaagcctgaggtgtgggcgggatgggaggtctgacatagtttgtgccaccaggttcccaaaagcgaccatggctgctttggcttgtgcaactctgattcggcatttcctggcttgccggcctcgttgcagctagctgggcctgggcattgtccagtgtgggaggagcaggaatcaatggcctttcaaaatagtgtcttggctgggcacggtggctcacgcccataatcccagcactttgggaggccgaggcgggtggatcacgaggtcaggagatcgagaccatcctggctaacacggtgaaaccccgtctctactaaaaatacaaaaaaaaattagccaggcgcagcggcaggcacctgtagtcccagctactccggaggctgaggcaggagaatggcgtgaacccgggaggcagagcttgcagtgagccgagatagcaccactgcagtctggcctgggtgaaagagcaagactctgtctcaaaaaaaaaaaaaaatactgtcttagggagaatgcccttttccttctgaagtgctgcgggaaggcaccagcgtcatttatagcgtgcagcaggaatgggcagattgttgctcaggtaccgtctttaccacgtagtaaaagatacctatatagaatatggtgatagaatattggacaaaagatgtcactaaatccaacagatgtttttctgcccttctgttcagcctctgtaggatcgggcattattggtcactcagttttctgtgaagactcctcctcctcttggctgcggaggaggaggctggcagctcattgcctggttctcgtcctctccctctccttctgtaggcttttctttccctagaattctcatagttctgagggtctagatcctttttcctttctacgtactctagaggccattccatcctctccccaggtccactcaccaccttacaatgatgtcttccaaatctctgtcttctgagctccagactgaagcgctccccatctcttctgcactcagggctggatatcatcccctacctccctcttccagtcagcaagctcagatgctcctaccttctaaatcccaaatccatcttcagtgtgaccctttctgtctccttgccaccatccccctgtcattcccttgctctgggccactgtcctctcctcctaaatgtctgcagcacccttatggtgtccttgcacagctttgttccatcatctcattctccaagctgtagccagagggactgtctaaaacatggcaaatgtgtcagcccctattaaaaacccttcatcggacttccattaagctcagtttataaagctcaacttccttccatgacttacagtgcccttcgtgatctggcctgcctgctcttccagcctcatccctgcattccagccatatggaactcttcttaattcttcaggaacaccatattctcttccactgtaggtgcaggtctgtgcactcgctgtgtccttggcctccactccccgctacctccatctgaactttctcaacccagtgcatttgcattggataattcttaacttcatactctggatttcaacttaaatgtcacttcttccaggaagtcttccctgcctgctctgcgccttgtctcagccccactgaatctgatgtagttctcagctgtgtgctcccagagtactttgcacagattttattgtgtttgcttgttttaatggtctgtctcttccacttgattgcatcctccttgagggctgtgactgtattttgtttgcggttgtatgcccagtgccataattgaatcaaatgttaagtttcaatggaaaccgcagtggtatagcaacagacatattgagctattttctgatttttcttagctgtctaaaacttacagatagccaatctttacctttcataatactgagttccattgcattatgccagagctctctgttacttgaagctgtgccagtttgaagaagcaaagcaggactgtgatcaggcacttcagctagctgatgggaacgtgaaagccttctatagacgagctctggctcataaaggactcaaggtgaggaaatcttcattttaatgcataaacttcagctctgaacaaatcaagtggttttcacaagcataaatctccagatcttgggatgggattgaggttattcttggatttaatcctagaactgtactaaccagttctaaaaccttgatagaggcctcagatttcacccctaaccataatgtgaaactagattgcttctaagattccttccagctccaaaataatgatttattctctagttttctgaggaatattgttagttatagtaggttcattttaagatagaggaaggtttggtactgaattaccgaaactagcagtaatgctgctggttcctccggcaaggattgctgttggaggttgggtggggaaggcatcagaatagaagatgggtgacccagcggaagttgggagagacacatcggagacttgaaagcttatagtgatctgggccttaagccagctgatggtcagtgtaaatctgtaaaatgccattcttctctaagaaaaccatgccattagtttagaagaaagtggatattgtatcattccacttttcttcacacagattcttctgcatggaaatcctgaggaatgaatgttcatatttatagaaaataacatcacaaggaaaaaccagaacatattggaaaatagtacttcctgaaataattttttaagctcaattttattaaggtgtaatacaatgaagttcatacattgtaattgtgcaggtcattgacttttggtatgtgcatatcctcttgtagccaatatcccaatcgagataaagaacattttcttctgaaggtggtgtgtgctaaaaaaaaataacattttcatctttctagaaagttctctgtgcccctgtacaataaatcttcctccctccacccctaccctcaggcagccattcatctgatttctatcactatagattagttttgattgttttggacattaccataaatcatatagaatggactctactgtttggcttctttcagcataacctgagatttgtttatattgtgtgggtatcaggaactgttcctttttatcaccgtgttgtatgaatatatcacaatttgtgtatatattcaccagttgatgacacttaggttgtttccagtttggggctgttaggaataaggctgctgtgacattcttgtgtacatttttaatggatggacttgtttacaaactgtacagctggaggccagatgtgactaggagtggggatagagggagatggtcagatcctgaggggcttggtaggccatgctgaggaggctggacttaattctgaaggtgatggagcctccagagcagggtaaatggtggtgtaatggatcagatttggggacctcatggaaggttgataagaggggcccaggatgaggaggaaggtaagtgagagatcaccaaggtgagaagcaggtacctgaaggaaagtaatgtccaaggaaagggagaagtatgttagctgctgtggctgctataacaaagcgccatagactgggtggcctgaacaacagaaatctattctggaggtgggaagtctcagcttgcggtgttaataggggtggtctcttcagaggcctatgtctctggcttacagttgctgtcctctccctgggtctccatgtggccttccctctgtgtgtgtgtgcccaaatcttctctttttataaagacacagtcatcttggactaggtagggcctactgattttaacttgattacctctttaaaggccctgtctccaaatatggttacattttgaggtactggaggttagaacttcaacacaggactttctgtggggacgtagttcagcccataacagaagggaaggggccaattcaagggtttatggtaaagttgacatagcagtcaaatgtctaggggaagtgatggaggggatgcctcccaggttctggctgggtggctgagggtagtggtgtgataatggggagcattcaggagcggggcagtttgggagtggggagaggattgttttgactgattgagtctgagatagttgttttaattccgtgcccatgactgaaagggaactatctaggttctgcagggagaagagcagtcatgttgcataatatagcaaatgaggaccacccaggtgcactgaatggccaccttttccagattgtagatccactctggctgcagtgcagtcagcgtgcatgtcccgccaggacccccgtgctgccctgtgacccccgccccatgctgagggagccacacagtgtccatgtgaccctaacacatgcctccccgccggccctctttttttttggttagcaacacactcacttgtaaaaaaaattcctagatggtgtatggcaccacaaattaaaagagactcctttgaaatttactcacctctttgagcttagtagatttggtaaatgaggatctgtatggctcatgagtttacagatggccaaactcttggagcacatttacctcttactggctgcctgactttctgaacctggtgagctgactaaaggtcagaagctgcaccctaatgaaagactggactttagtttgtgtgggtatcatcattaatacttcattggacttttctatttccttggaatgaattccagaaattatattatgatgcagaaaaataatcccaaatttgagtaatcctatcccactagattatgaggctggtagcttatagcttgatttgttgtccagtaatttgaggtatgtgccaggtgaatttaatttcagaattttaaaaaatgtttaagagagacagggtctcactatgttggccaggattggtgttaaacccctggcctcaagcaatcctcccactttggcctctcaaaatgctaggattacagatgtgtgccaccatgcttggcctaatttcaggatcttcaaaggctacaactgcttatagaatgtgtcagaactcacgcccaggcctgtttgcccagggtgactgcaatgaggaagtggcacaggggctcacggtggcaggtgtcctgcctttagctcccagctcaactctatgttttcctcagatcttctgtttgttttctgactttgttatttttaatggtgccagctttgaaaaatatgagctttctttaatgtacagctgttctttgtaagaaaagatcactgaacattttgcttttatttacaatttatttctcttattgagtgccaattatgtgctaggtgttaggagtatagaggtgaataaagacatggtgcctacttagggaatttacacccaatagagggtgctgcaagatccacccaaaagaggatgctgtagaggatgatacatacaattgttatgtatcaatacaaatatcaaaaagaatatcataaaataactattgcttttatggtttcagcaaaactattaatggtaaatatcacaaacacgtgattataatacatccctttttaaaggcctaatgaggttagcaacttttaatgccttctttcttgtcaaagctacattttctggtttgttgttgttattgtttgttatttgtttatttttgagacagagtcttgctctgtcactcaggctggggtgcagtggcgtgatcttggctcactgcaacctccacctccagagttcaagcaattctcctgcttcagcctcccgagtagctgggactacagatgtgcaccaccacatctggctaatttttgtatgtttagtagagacggggtttagctgtgttggtcaggctggtctcgaactcttggcctcaggtgatccacccaccttggcctcccaaagtgctgggacacactttctatgagctctgctcttccctctacactgcatggctgggttctcttcaggtcttgacttctctgacacctgtaactgtagaaaaaggaggctctcttgttagtatccatctcaacctttagttttctccatgacatcaatgacagtctgtaattatctattcatttgtttacaggtttttaattgcttcccctcataggacgtaagcttccataaatgtaaaacttaagtctgtctttctttgtcttttccgtggtcctcttagctcctggcacatggacgtgctcagagaccatctgtgaagtgaatgagcctcgccccctcttagctgcctccttgcccaattctgtctatgcccttgctgccattctgccctcttcatgcttgtctgcagtgctaacacttgtcaacatgcatttcttgttttcttatgtctcttccaaccagtcaggctgctctttaggcagagactttccggattcatgaaaatgatcctattgactcctagggtgctgagcttccatttccaaggctgtggctcacaggtctctatttccagtcctttcccttgagctccatgccatgtaatcatccaccttctggtcattgctgttgtgaccatcccattcttcatttttaaaatgggaacaatagaagttaatatttgtagggctgttgtgagggtaaagtaataattgtaaaatgcttagaatggtaagaatcagcctttattacttcctcaacttgccctcctgctccactcccttgcctttcaggtatggctccctgcctagaacgcttaggatataaatacagtgtcatttttcccccggtaaggttccagtgctggtctaggacagtggtatctggagatttgttatactttgtaaataatttacttttataaactagagcagatttaaggttatccctttaaatatgtccctcttgctctggtgtgttgctgtaggggaggggaaaggcatgtgggattacagctaggcccccgggaatgtcacataatcactagctcagcttatctgtgctcagcctcttgtgcatgctgttactgatgtgtcatgaatacttgaagaggttacacatccttgcaattctttgcctcttcacagtttggtttattcaaaacatgggtctagtctgtagtttagaacatagcttgtcacagcagactgactttggggcatctgtctttgctgctagattcagtggtcatgtcttgttaggtgccctttctttccctcaacttcttcagtgtattgtgtgactcatggaagattaaatgttgactctagccaattcgaagagtaaacaacctggaaggattttatggaacaaaagtattataataactaccatttgcatagtcctttataggtttaagccacttattatttgttcatttatttcttggtacagccttgtgaaaatttgaatagagcttttgttccccttatgttaaagatgagaagactgaagcccagaaaggttaagtaggatcttaagtttcattgctagtaggtgctaatacaaggatgagttcattctttcatttattcattcagcaagcaacaagtgcttatcatgtgttagggactgggaaggttgtggtgatacagaatttaacttgcgttttctaactccagatcctgtgctttttcttctatagtcgatgttcactgtatcatgggttatactatttcagctgcatattcaccccacaggctcactttgtaagagtggtattaatgtggaccctgcacacatactgcacagctcactacatccaccccactcccactcaggttactctaggctccttctatttatgaaagttattttctctgtcttcctacttacagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtatttgtatttgattatctttgaaagtactcctttggggaccttagactggattctaaggtcatattcctgtgagttctaaaacatttttaattttgtgtttttattctgatgatcagtgacaaaattttaaccagcaacaaaatgtctcctttgcaatgataattagccattgtatttcccaacgtgggtccatggatggtactgggagtctctgcattactgcagttcttcctttctttggcctccatctgtactgctcccactccagagtacactgggaaccagcggccactgactttgctccagggtagacctggagaatcctgacgggactgattttgttacaggggccctgaaagcctcacctcatagagattatccagattgattcagacctttttagcactctgaaatatgactgcctcatcagagatctcgaactacctcaggatcaaactgcttttgtgattcagataactaaaatgtttttctctgcctaatattagggaagaatgttaggctgtgaatccctgtacattcatgaatgctaataccccatttatagtctcacatttccactaagagtaagaggctaatatgtaagagaagctaggaaggttttttttcctctttaaggagggaagaaaaaactgttttaggagaatcgagcaatgtaagttcatttctctgttaaaatttattgtgaaaaggagataaaattgacataggcatttatacaacaattgtataaagtctaaaaattaaattttgttgtcatagtttcaatgtcaaataattttttaaaacttttatgaattggatcttacaccctaaaacttctcttcctaaaaaaaattattacaaagttttcacttggaactggactacagtacagtctacttgtagttttcaattctcattctgacagacgtacttaggatgtatgtggtgattgtggttcagtgtcacaatgcatttttcttttcttcatgaaggtgaatgaaggcaaggaggagcctggaagacctgcaggggaggtctccatgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaaggtaagtggctaagtattttattagtagaaattggttttattagggtttctgtaacttaaaaatgttacttatgctaacatagttggttttttgtttttttttttttttgcttcttttagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctcca

SEQ ID NO: 43 - DNA, 6018 bp, Artificial Sequence
  Based on Homo sapiens sequence
aacccacctcaaccatcctccaaccgtaaagggtgatgatgattcatgaaacagtccaggaggaggagggacttcaggttttgtttgattcatttcagtggcccaacagtggcatcaaggaccttggctctcccatctcctctgctttcacccaaggctggcttccccttatggccatgagagaacagaggagccttccaaagtgctctctccttcatgggttattagacaccaagctcattcccagagcagtcacgggagtgtggccttcacttttggccagagacagagccaactcctagaaagcggagggagacagtgtcccaacctaatcaatggctcccatgaacgccagggaaaaaaagggaattccactcctccatcctaggaaagttggagtccttccttagggtggaggaagtgggaaacagatgctgataagacctccacggaggtgatgtctggagctgcaaccagggaagacctggctgcagacatatttgagtctttagctcaagagtgaaccccaggctgcaataaagatctgacagttaccaatgctagaaggctgatggacaaagcaatgacgataacccagagagagactgtatgcaactgaaacttcaattgctaaatgtctgtagggctgttgagacagttgcttttcagtgtatccattgcctgaaaattaccagatgtcagaaaaattgaaggagtcttaaatggcaatttcatggacattaagtgatattaaattttttaaagttacaatgctgaccccaataaattacttagaaacagcaaaaggaatagtgtggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccaggtgggcgggcctttaggggggcggtgtttcgagaggggcgtgtcttccggggacgagttttccgggcggggccggcttcgggattgggacaggcacttccgggaggggcgggtctctctcgtgagggcgggcttagggaagcagagaggcacttccgggttgggcggggcccactcttacagctgggcccgccttggcccctgctggccattagcgcgacttggggttattcagtacacttcttgtttgcagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaaggctggtctttacccttcttcctcactgtcatatcgagttttcctttgtgtgtgtgtgtgtgaaacatagtgcttttaattttatatttccggctgaggtgatgcacaaattatcttacagacacaaaaagaaatacatttggtaaaacatcgaagacaaattaagaaaaagcaaatagggatcctccattatttacactccagaatcttgagtgtttgggggtgccggcgcattctaccagtctcagggaaggacatgagtacagactacagtaatcagaatctgagtcataggtgaaatcaggaaaagcaactcttcttgtgtttatttttagtagtgtcataagaacggactagttcttcctgcgtgaccacggatgcttctgtttgagaaaatgcatacccacgtgggacatttagatcaagaaagctgttgatgaagacattgttgaagggcaacttgggtgattggggaattattctcttcatcagcccctctgcaatacagctggagctgtcccataggagttcggacaattacggacatcctttttctttctctctttctttttttttgtttgtttgtttgagacagagtctctgttgcccaggctggagtgcagtggcgcaatcccggctcactgcaacctccgcctccctggttcaagtgattctcctgcctcagcctcctgagtagctgggactacaggtgtgtgacaccagacccggctaattttttgtatttttagtagagatggggggtttcaccatgttagccaggatggtctcaaactcctgacctcgtgatccacccacctcagcctcccaaagtgctgggattacaggcgtgagccaccgtgcccagcctcctttttctattactagagaactccaggacattaagaatttcaaaagtgattttttcacccatggcttctacggtgacagagtatggtgttcctgtagggaaacaaagccaagtttttttgctcctttcactaaagctgcttcatccggggaggaagcctggtagattataatatttccagggataacagtgtggcacacagataacagggtaagaaattggtctatatagttttctgtgggatggccattctcaatgttctccaataaactggggtaattaaaatatcagggctcggatggaaggtgttgcaccataaatgacacctgcagtggtacttgttaaatgtcttaacattgcaagtgagggttcccattttatcagaaaatagaaattttacctgcccaagttcttcactgagattgaatgtgctggccatggtgtggacactatttactttataatgcacatcttgatcccagtttataaactgggcctgaatatatttcacaatttccatagtgaccagcagactaatggggatgaggtactgttataagatgatgaacaccagtatgtcaaacacaatgctgtgagctggaatcctctttcaggtaccaaatgtcaccatactttttattccatagcacggctcccacgcagctcactacagacatgaccagagcagcaggaaccaaagggagacccgcccattgtcactttcttaatctctgatctcttgaggtgatttgacagaattctgcaggaatttggtttcaaagccagtgtaaacaactatgccagtgatccactgagcatttcttttttttttttcttgagacggagtctcactctggtgcccaggctggagtgggcgccatcttggctcactgcaagctccgcctcccggcttcatgccattctcgtccttcagcctcctgagtggctgggattacaggcgcccgccaccacgcctagctaatttctttgtatttttggtagagacggggtttcactgtgttagccaggatggtctcaatctcctgacctcatgatcctcccgcctcggcctcccaaagcgctgggattacaggcgtgagccacctcgcccggccaatccactgagcatttctaagctgtgtatctcttaacaagacccagtcaggccctattggaacagggcttttaccacctaggcggaagctcagccattgaaatgacgatcaggtgcttcacggtctatttttccagataggcctaacagctggttttctgtttgcatttcagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagcattggcagctttggtaaactgcagattcaaaaatcgagggagaaatgagcacacgctgtacttggctgtacatataattgctgactgtgggttgcagaaatttctctcaagcatcatcaccacttttgctcagttatcagtagtaataacagcaatcaaaactgaaactgctccagatgcctgtctaggaagtatggttttccatccttcctactgctttcttcacaagagaatcctccacctcagtggccctgaagtggcctgaagggcccgctctgcggtcctgccaccagtgccctctgaggtccatggtcccacggcaccacggccgcccagtgcactcgcctccacactgagttttcatttttcccagttaagccccatcttccggaaatgcagctccagagggtctctgtcccctcttgctggtggggcaagggtctgcgcatcagaccacatggacccctgcaccaccatctgctccgtcctctccctctggtcagctcagcttattaaacaagccttggtcaggaaaatctaaaccacttaaggaactgggcagaaagaaactgaatgcagggagaagaaggctggggagccaaggacaggagaggagacataggggagtcacagggacctgccacccagatccccactgcctgatgtcctggctgtggagggcacctggagctgccagcagagcctcctgcccaccagctgctgaagccacagtacatctccttcctcccacctcccagacctctcactggtctcatctgggcaccgaacatgggaagcccctcctgtgacaggcaggggagaaggaggctgtgctgacagacggcctggtgagggaacccgggaggcctccagcatctgcacccctctcctactttgatctctgtttcaccaacattgcaccccaacttaaggtcacatagctactgtcaagccaacaaggtgctgcctctcccgccgtgtgagggtggaaccccataagccaccactggaggcatccaagcatgttgattccttctctagttcagacaccacctctcctggacatcctgtggcctaaagactatcctagaatcaacactccttaaataggagtggggaaagaaaaggaaaatgtgtgtaatacatgtgaatcacagataacgtagtcattggttaatatatacaactacgcgtatttacattctgtatgcgtcaatgagtaaaatactgtggttggtgctta

SEQ ID NO: 44 - DNA, 6018 bp, Artificial Sequence; identical to SEQ ID NO: 43
  Based on Homo sapiens sequence

SEQ ID NO: 45 - DNA, 489 bp, Artificial Sequence
  Based on Homo sapiens sequence
atttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaa

SEQ ID NO: 46 - DNA, 4052 bp, Artificial Sequence
  Based on Homo sapiens sequence
atttcctgccctgaaagcagcctcgagggccaacaacacctgctgtccgtgtccatgcccggttggccaccccgtttctggggggtgagcggggcttggcagggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcaggtaaggggtaggagggacctcaactcccagccttgtctgaccctccaattatacactcctttgcctctttccgtcattccataaccacccaacccctactccaccgggagggggttgggcatacctggatttccatccgcgcacctagccacagggtccctaagagcagcagctaggcatgggagggctctttcccaggagagagggggaaggggacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggaggagccaatccagggtgtagggggcccagagtgaccaggtgcactagggaaaaaatgccaggagagggccaggaagaggacttgttagtagcgactcacttctgggcaggcaggccagccagctagccagcctgctgaggcttcccaagaggggcagagtgctgggatctgggaatccaggaaaggagggaatggggtggggctagatgaaaagggataggtgtccagggagagcctctggctattcctgggaccaggaagttttcactaggatacataacactttttacacactcaccccacccatccctggctttctattcatggaacaacctctctctacaatccctccagatcttcgcaaatactgtggacaatgcccgcatcgttctgcagattgacaatgcccgtcttgctgctgatgactttagagtcaagtaagtttgggggctagagagctgggggtccaggggtggagctaagaaggatctgctccccaggctgggtcagttaggggctcacagtgggatcctgttaggtgtgggtggatgagagtcagggtccatcagtgtattcatttaactgttcatttgtataaccccgtttaagaatactgtcctccaagtgccaagaatggtgctcaggggattaccacctaattgctgactcaagttgctggtttgcaatgggcacagaacttctcttagtaggtggcatgagttgagaaggttctggatcagagataggggcccctctgatcacctccactcctataggtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagaccgttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgccctgagtgcaagccaaggggttcctcctgtctcttctccaactgtaggcctcctagaagaggcaatcacagaagaaaggccttgttggagctctgaccctgaaccctcctcacttttgcccctgtcacctttaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctggtgagtgccttcacatcacctgcccagctcctccttcacttggcctcagacccaaccctgtctcaacccaaatcctatccctcatatcatgagttcctttagctcagaaagagtcagtttcctctttgcatttccctccactcctatcccttatcccagtacttggcacatagcaggtgcccaaaaaagtttccaaaagtgaagggatgagcagtcctgggactctgggctcaccctgcccctcctctctgtgcccctgcagaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattgga

The invention claimed is:

1. A method of generating multipotent cells, the method comprising the steps of:
providing an adult peripheral blood sample;
isolating peripheral blood insulin-producing cells (PB-IPC) comprising a nuclear membrane including a CXCR-4 protein receptor from said adult peripheral blood sample by applying said adult peripheral blood sample to a hydrophobic surface and said PB-IPC adhering to said hydrophobic surface;
isolating mitochondria comprising an SDF-1 protein ligand from said adult peripheral blood sample;
treating said PB-IPC adhering to said hydrophobic surface with said mitochondria;
said SDF-1 protein ligand of said mitochondria interacting with said CXCR-4 protein receptor of said PB-IPC, resulting in said mitochondria entering nuclei of said PB-IPC; and
said PB-IPC comprising said entered mitochondria forming multipotent cells configured for accommodating reprogramming of said PB-IPC for multipotent differentiation.

2. The method according to claim 1, further comprising the steps of:
isolating peripheral blood-derived mononuclear cells (PBMC) from said adult peripheral blood sample; and
wherein said isolating PB-IPC from said adult peripheral blood sample comprises applying said PBMC to said hydrophobic surface and said PB-IPC adhering to said hydrophobic surface.

3. The method according to claim 1, wherein:
said isolating mitochondria from said adult peripheral blood sample comprises isolating blood platelets from said adult peripheral blood sample and isolating said mitochondria from said blood platelets.

4. The method according to claim 1, wherein:
said isolating mitochondria from said adult peripheral blood sample comprises isolating PBMC from said adult peripheral blood sample and isolating said mitochondria from said PBMC.

5. The method according to claim 1, wherein:
said isolating mitochondria from said adult peripheral blood sample comprises isolating plasma from said adult peripheral blood sample and isolating said mitochondria from said plasma.

6. The method according to claim 1, wherein:
said adult peripheral blood sample comprises a first adult peripheral blood sample from a first source and a second adult peripheral blood sample from a second source;
said first adult peripheral blood sample being used for said isolating said PB-IPC; and
said second adult peripheral blood sample being used for said isolating said mitochondria.

7. The method according to claim 1, further comprising the steps of:
treating said PB-IPC having said entered mitochondria with a promoter for desired differentiated cells; and
said PB-IPC having said entered mitochondria developing into said desired differentiated cells.

8. The method according to claim 7, wherein:
said desired differentiated cells are selected from the group consisting of: macrophage cells, neuronal cells, RPE cells, granulocyte cells, T cells, B cells, red blood cells, megakaryocyte cells, platelet cells, bone marrow cells, stromal cells, osteoblast cells, keratinocytes, hair follicle cells, gland cells, endothelial cells, corneal endothelial cells, cardiomyocytes, muscle cells, epithelial cells, hepatocytes, kidney cells, and islet β cells.

9. A method of generating hematopoietic stem cell (HSC)-like cells, the method comprising the steps of:
providing an adult peripheral blood sample;
isolating PB-IPC comprising a nuclear membrane including a CXCR-4 protein receptor from said adult peripheral blood sample by applying said adult peripheral blood sample to a hydrophobic surface and said PB-IPC adhering to said hydrophobic surface;
isolating mitochondria comprising an SDF-1 protein ligand from said adult peripheral blood sample;
treating said PB-IPC adherent to said hydrophobic surface with said mitochondria;
said SDF-1 protein ligand of said mitochondria interacting with said CXCR-4 protein receptor of said PB-IPC, resulting in said mitochondria entering nuclei of said PB-IPC;
said entered mitochondria upregulating HSC marker CD34 in said PB-IPC; and
said PB-IPC comprising said entered mitochondria forming HSC-like cells configured for accommodating reprogramming of said PB-IPC for hematopoietic differentiation.

10. The method according to claim 9, further comprising the steps of:
isolating PBMC from said adult peripheral blood sample; and
wherein said isolating PB-IPC from said adult peripheral blood sample comprises applying said PBMC to said hydrophobic surface and said PB-IPC adhering to said hydrophobic surface.

11. The method according to claim 9, wherein:
said isolating mitochondria from said adult peripheral blood sample comprises isolating blood platelets from said adult peripheral blood sample and isolating said mitochondria from said blood platelets.

12. The method according to claim 9, wherein:
said isolating mitochondria from said adult peripheral blood sample comprises isolating PBMC from said adult peripheral blood sample and isolating said mitochondria from said PBMC.

13. The method according to claim 9, wherein:
said isolating mitochondria from said adult peripheral blood sample comprises isolating plasma from said adult peripheral blood sample and isolating said mitochondria from said plasma.

14. The method according to claim 9, wherein:
said adult peripheral blood sample comprises a first adult peripheral blood from a first source and a second adult peripheral blood sample from a second source;
said first adult peripheral blood sample being used for said isolating said PB-IPC; and
said second adult peripheral blood sample being used for said isolating said mitochondria.

15. The method according to claim 9, further comprising the steps of:
treating said PB-IPC having said entered mitochondria with a blood cell promoter; and
said PB-IPC having said entered mitochondria developing into differentiated blood cells corresponding to said blood cell promoter.

16. The method according to claim 15, wherein:
said differentiated blood cells are selected from the group consisting of: macrophage cells, granulocyte cells, T cells, B cells, red blood cells, megakaryocyte cells, and platelet cells.

17. A method for multipotent cell generation and medical treatment, the method comprising the steps of:
providing an adult peripheral blood sample;
isolating PBMC from said adult peripheral blood sample;
isolating PB-IPC comprising a nuclear membrane including a CXCR-4 protein receptor from said PBMC by applying said PBMC to a hydrophobic surface and said PB-IPC adhering to said hydrophobic surface;
isolating mitochondria comprising an SDF-1 protein ligand from said adult peripheral blood sample;
treating said PB-IPC adherent to said hydrophobic surface with said mitochondria;
said SDF-1 protein ligand of said mitochondria interacting with said CXCR-4 protein receptor of said PB-IPC, resulting in said mitochondria entering nuclei of said PB-IPC;
said PB-IPC comprising said entered mitochondria forming multipotent cells configured for accommodating reprogramming of said PB-IPC for multipotent differentiation;
treating said PB-IPC having said entered mitochondria with a promoter for desired differentiated cells;
said PB-IPC having said entered mitochondria developing into said desired differentiated cells; and
treating a patient with said desired differentiated cells.

18. The method according to claim 17, wherein:
said desired differentiated cells are selected from the group consisting of: macrophage cells, neuronal cells, RPE cells, granulocyte cells, T cells, B cells, red blood cells, megakaryocyte cells, platelet cells, bone marrow cells, stromal cells, osteoblast cells, keratinocytes, hair follicle cells, gland cells, endothelial cells, corneal endothelial cells, cardiomyocytes, muscle cells, epithelial cells, hepatocytes, kidney cells, and islet β cells.

* * * * *